US009487763B2

(12) United States Patent
Sherman et al.

(10) Patent No.: US 9,487,763 B2
(45) Date of Patent: Nov. 8, 2016

(54) NONRIBOSOMAL PEPTIDE SYNTHETASES

(71) Applicant: REGENTS OF THE UNIVERSITY OF MICHIGAN, Ann Arbor, MI (US)

(72) Inventors: David H. Sherman, Ann Arbor, MI (US); Michael Marie Kaufman-Schofield, Ann Arbor, MI (US); Sunit Jain, Ann Arbor, MI (US); Gregory Dick, Ann Arbor, MI (US)

(73) Assignee: REGENTS OF THE UNIVERSITY OF MICHIGAN, Ann Arbor, MI (US)

( * ) Notice: Subject to any disclaimer, the term of this patent is extended or adjusted under 35 U.S.C. 154(b) by 11 days.

(21) Appl. No.: 14/713,662

(22) Filed: May 15, 2015

(65) Prior Publication Data

US 2015/0361470 A1    Dec. 17, 2015

Related U.S. Application Data

(63) Continuation-in-part of application No. 14/603,032, filed on Jan. 22, 2015.

(60) Provisional application No. 61/930,166, filed on Jan. 22, 2014.

(51) Int. Cl.
| C12P 17/18 | (2006.01) |
| C12N 9/10 | (2006.01) |
| C12N 9/00 | (2006.01) |
| C12N 9/88 | (2006.01) |
| C12N 9/02 | (2006.01) |

(Continued)

(52) U.S. Cl.
CPC ........... *C12N 9/1029* (2013.01); *C12N 9/0006* (2013.01); *C12N 9/0051* (2013.01); *C12N 9/0095* (2013.01); *C12N 9/1007* (2013.01); *C12N 9/1025* (2013.01); *C12N 9/88* (2013.01); *C12N 9/93* (2013.01); *C12N 15/52* (2013.01); *C12P 17/185* (2013.01); *C12Y 108/01007* (2013.01); *C12Y 118/01002* (2013.01); *C12Y 201/01* (2013.01); *C12Y 203/01* (2013.01); *C12Y 203/0104* (2013.01); *C12Y 203/01187* (2013.01); *C12Y 402/01001* (2013.01); *C12Y 402/01059* (2013.01); *C12Y 603/04015* (2013.01)

(58) Field of Classification Search
None
See application file for complete search history.

(56) References Cited

U.S. PATENT DOCUMENTS

| 4,518,584 A | 5/1985 | Mark et al. |
| 4,737,462 A | 4/1988 | Mark et al. |
| 7,309,601 B2 * | 12/2007 | Perez Esteban . C07K 14/43504 435/252.3 |

(Continued)

OTHER PUBLICATIONS

Altschul et al., Basic local alignment search tool, *J. Mol. Biol.*, 215, 403-410 (1990).

(Continued)

*Primary Examiner* — Robert Mondesi
*Assistant Examiner* — Richard Ekstrom
(74) *Attorney, Agent, or Firm* — Marshall, Gerstein & Borun LLP

(57) ABSTRACT

The present disclosure is directed to the biosynthetic pathway for a nonribosomal peptide synthetase (NRPS)-derived drug and analogs thereof. The invention provides polynucleotide sequences useful for heterologous expression in a convenient microbial host for the synthesis of the NRPS-derived drug, the polypeptides encoded by such polynucleotides, expression vectors comprising the polynucleotides, host cells comprising the polynucleotides or expression vectors, and kits comprising a host cell. Also provided is a method for the production of ET-743, the NRPS-derived drug.

15 Claims, 18 Drawing Sheets

Figure 1A:
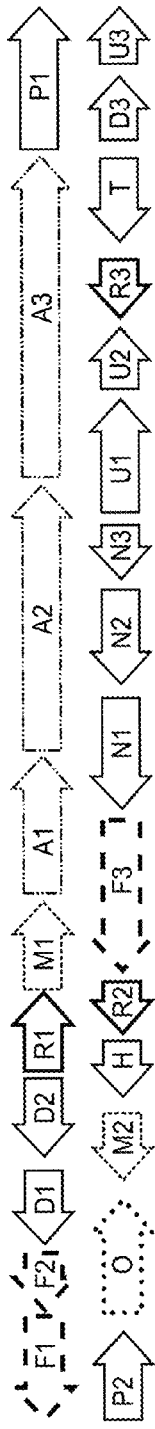

(51) Int. Cl.
C12N 9/04 (2006.01)
C12N 15/52 (2006.01)

(56) References Cited

U.S. PATENT DOCUMENTS 7,723,068 B2 * 5/2010 Iglesias .............. A61K 31/4995
435/320.1
8,815,562 B2 8/2014 Sherman et al.

OTHER PUBLICATIONS

Bauer et al., A genetic enrichment for mutations constructed by oligodeoxynucleotide-directed mutagenesis, Gene, 37:73-81 (1985).
Bovarnick et al., Reversible inactivation of typhus Rickettsiae. I. Inactivation by freezing, J. Gen. Physiol., 38:169-79 (1954).
Cane et al., Harnessing the biosynthetic code: combinations, permutations, and mutations, Science, 282:63-68 (1998).
Carballo, Production of Ecteinascidia turbinata (Ascidiacea: Perophoridae) for Obtaining Anticancer Compounds, J. World Aquaculture Soc., 31(4):481-490 (2000).
Chen et al., Concordant evolution of a symbiont with its host insect species: molecular phylogeny of genus Glossina and its bacteriome-associated endosymbiont, Wigglesworthia glossinidia, J. Mol. Evol., 48:49-58 (1999).
Chen et al., Total Synthesis of Ecteinascidin 743, J. Amer. Chem. Soc., 128: 87-89 (2006).
Chu et al., From hormones to secondary metabolism: the emergence of metabolic gene clusters in plants, Plant J., 66: 66-79 (2011).
Ciccarelli, Toward automatic reconstruction of a highly resolved tree of life, Science, 311:1283-7 (2006).
Corey et al., Enantioselective Total Synthesis of Ecteinascidin 743, J. Amer. Chem. Soc., 118:9202-3 (1996).
Craik, Use of Oligonucleotides for Site-Specific Mutagenesis, BioTechniques, 12-19 (1985).
Cuevas et al., Synthesis of ecteinascidin ET-743 and phthalascidin Pt-650 from cyanosafracin B, Organic Letters, 2:2545-8 (2000).
Cuevas et al., Development of Yondelis (trabectedin, ET-743). A semisynthetic process solves the supply problem, Natural product reports, 26:322-337 (2009).
Davis, Alkaloids and ascidian chemical defense: evidence for the ecological role of natural products from Eudistoma olivaceum, Mar. Biol., 111:375-9 (1991).
Dick et al., Community-wide analysis of microbial genome sequence signatures, Genome Biol., 10:R85.1-R85.16 (2009).
Endo et al., Total synthesis of ecteinascidin 743, J. Amer. Chem. Soc., 124:6552-4 (2002).
Fishlock et al., Synthetic studies on Et-743. Assembly of the pentacyclic core and a formal total synthesis, J. Org. Chem., 73:9594-600 (2008).
Fusetani N (ed): Drugs from the Sea. Basel. Karger. Chapter: Dominick Mendola Aquacultural Production of Bryostatin 1 and ecteinascidin ,743: 120-33(2000).
Görke et al., Carbon catabolite repression in bacteria: many ways to make the most out of nutrients, Nat. Rev. Microbiol., 6: 613-24 (2008).
Gribskov et al., Sigma factors from E. coli, B. subtilis, phage SP01, and phage T4 are homologous proteins, Nucl. Acids Res., 14:6745-6763 (1986).
Hahn et al., Selective interaction between nonribosomal peptide synthetases is facilitated by short communication-mediating domains, Proc. Nat. Acad. Sci. USA, 101(44):15585-90 (2004).
Henikoff et al., Amino acid substitution matrices from protein blocks, Proc. Natl. Acad. Sci. USA, 89:10915-10919 (1992).
Ikeda, Safracins, new antitumor antibiotics. III. Biological activity, J. Antibiot.,36:1290-4 (1983).
Karlin et al., Applications and statistics for multiple high-scoring segments in molecular sequences, Proc. Natl. Acad. Sci. USA, 90:5873-5877 (1993).
Kuo et al., Deletional bias across the three domains of life, Genome Biol. Evol., 1:145-52 (2009).
Kuo et al., The consequences of genetic drift for bacterial genome complexity, Genome Res.,19:1450-4 (2009).
Kwan et al., Genome streamlining and chemical defense in a coral reef symbiosis, Proc. Natl. Acad. Sci. USA, 109:20655-60 (2012).
Lawrence et al., Selfish operons: horizontal transfer may drive the evolution of gene clusters, Genetics, 143:1843-60 (1996).
Lichter et al., Ecteinascidia turbinata extracts inhibit DNA synthesis in lymphocytes after mitogenic stimulation by lectins, Exp. Biol. Med., (Maywood) 150:475-8 (1975).
Lindquist et al., Defense of ascidians and their conspicuous larvae: Adult vs. larval chemical defenses, Ecological Monographs, 62: 547-568 (1992).
Marahiel et al., Modular Peptide Synthetases Involved in Nonribosomal Peptide Synthesis, Chem. Rev., 97:2651-73 (1997).
McCutcheon et al., Extreme genome reduction in symbiotic bacteria, Nat. Rev. Microbiol., 10: 13-26 (2012).
Mira et al., Deletional bias and the evolution of bacterial genomes, Trends Genet., 17:589-96 (2001).
Moran et al., Genomics and evolution of heritable bacterial symbionts, Annu. Rev. Genet., 42:165-90 (2008).
Moran et al., A Molecular Clock in Endosymbiotic Bacteria is Calibrated using the insect hosts, Proc. R. Soc. Lond., B 253:167-71 (1993).
Moran, Accelerated evolution and Muller's rachet in endosymbiotic bacteria, Prot. Natl. Acad. Sci. USA., 93:2873-8 (1996).
Moss et al., Intracellular bacteria associated with the ascidian Ecteinascidia turbinata: phylogenetic and in situ hybridization analysis, Mar. Biol., 143:99-110 (2003).
Munoz-Elias et al., Carbon metabolism of intracellular bacteria, Cell Microbiol., 8:10-22 (2006).
Nakabachi et al., The 160-kilobase genome of the bacterial endosymbiont Carsonella, Science, 314:267 (2006).
Needleman et al., A general method applicable to the search for similarities in the amino acid sequence of two proteins, J. Mol. Biol., 48:443-453 (1970).
Omsland et al., Life on the outside: the rescue of Coxiella burnetii from its host cell, Annu. Rev. Microbiol., 65:111-28 (2011).
Omsland et al., Host cell-free growth of the Q fever bacterium Coxiella burnetii, Proc. Natl. Acad. Sci. USA, 106:4430-4 (2009).
Pearson et al., Improved tools for biological sequence comparison, Proc. Natl. Acad. Sci. USA, 85:2444-2448 (1988).
Peng et al., Hijacking a hydroxyethyl unit from a central metabolic ketose into a nonribosomal peptide assembly line, Proc. Natl. Acd. Sci. USA, 109:8540-5 (2012).
Pérez-Brocal et al., A small microbial genome: the end of a long symbiotic relationship?, Science, 314:312-3 (2006).
Pérez-Matos et al., Bacterial diversity associated with the Caribbean tunicate Ecteinascidia turbinate, Antonie Van Leeuwenhoek, 92:155-64 (2007).
Piel, Metabolites from symbiotic bacteria, Nat. Prod. Rep., 26:338-62 (2009).
Pisut et al., Anti-predatory chemical defenses of ascidians: secondary metabolites or inorganic acids?, J. Exper. Mar. Biol. Ecol., 270:203-14 (2002).
Price et al., Operon formation is driven by co-regulation and not by horizontal gene transfer, Genome Res., 15:809-19 (2005).
Proksch et al., Drugs from the seas—current status and microbiological implications, Appl. Microbiol. Biotechnol., 59:125-34 (2002).
Rath et al., Meta-omic characterization of the marine invertebrate microbial consortium that produces the chemotherapeutic natural product ET-743, ACS Chem. Biol., 6(11):1244-256 (2011).
Renesto et al., Some lessons from Rickettsia genomics, FEMS Microbiol. Rev., 29:99-117 (2005).
Rinehart et al., Ecteinascidins 729, 743, 745, 759A, 759B, and 770: Potent Antitumor Agents from the Caribbean Tunicate Ecteinascidia turbinata, J. Org. Chem., 55(15):4512-5 (1990).
Schwartz et al. (eds.), Atlas of Protein Sequence and Structure, National Biomedical Research Foundation, 353-8 (1979).
Schwarzer et al., Nonribosomal peptides: from genes to products, Nat. Prod. Rep., 20:275-87 (2003).

(56) References Cited

OTHER PUBLICATIONS

Shigenobu et al., Genome sequence of the endocellular bacterial symbiont of aphids *Buchnera* sp, *APS Nature*, 407:81-6 (2000).

Smith et al., Comparison of biosequences, *Adv. Appl. Math.*, 2:482-9 (1981).

Smith et al., Genetic Engineering: Principles and Methods, Plenum Press, (1981).

Spry et al., Coenzyme A biosynthesis: an antimicrobial drug target, *FEMS Microbiol. Rev.*, 32:56-106 (2008).

Stachelhaus et al., Biochemical characterization of peptidyl carrier protein (PCP), the thiolation domain of multifunctional peptide synthetases, *Chem. Biol.*, 3:913-21 (1996).

Stachelhaus et al., The specificity-conferring code of adenylation domains in nonribosomal peptide synthetases, *Chem. Biol.*, 6:493-505 (1999).

Stachelhaus et al., Peptide bond formation in nonribosomal peptide biosynthesis. Catalytic role of the condensation domain, *J. Biol. Chem.*, 273:22773-81 (1998).

Staley et al., Measurement of in situ activities of nonphotosynthetic microorganisms in aquatic and terrestrial habitats, *Ann. Rev. Microbiol.*, 39:321-46 (1985).

Thompson et al., CLUSTAL W: improving the sensitivity of progressive multiple sequence alignment through sequence weighting, position-specific gap penalties and weight matrix choice, *Nuc. Acids Res.*, 22:4673-80 (1994).

Tourtellotte et al., Defined medium for mycoplasma laidlawii, *J. Bacteriol.*, 88:11-5 (1964).

Trager et al., Coezyme A requirement of malaria parasites: effects of coenzyme A precursors on extracellular development in vitro of Plasmodium lophurae, *Proc. Natl. Acad. Sci. USA*, 72:1834-7 (1975).

Trauger et al., Peptide cyclization catalysed by the thioesterase domain of tyrocidine synthetase, *Nature*, 407:215-8 (2000).

Velasco et al., Molecular characterization of the safracin biosynthetic pathway from Pseudomonas fluorescens A2-2: designing new cytotoxic compounds, *Mol. Microbiol.*, 56:144-54 (2005).

Walder et al., Oligodeoxynucleotide-directed mutagenesis using the yeast transformation system, *Gene*, 42:133-139 (1986).

Walsh et al., Tailoring enzymes that modify nonribosomal peptides during and after chain elongation on NRPS assembly lines, *Curr. Opin. Chem. Biol.*, 5:525-34 (2001).

Walton, Horizontal gene transfer and the evolution of secondary metabolite gene clusters in fungi: an hypothesis, *Fungal Genet. Biol.*, 30:167-71 (2000).

Wernegreen, Genome evolution in bacterial endosymbionts of insects, *Nat. Rev. Genet.*, 3:850-61 (2002).

Wilson et al., Metagenomic approaches for exploiting uncultivated bacteria as a resource for novel biosynthetic enzymology, *Chem. Biol.*, 20:636-47 (2013).

Wu et al., Metabolic complementarity and genomics of the dual bacterial symbiosis of sharpshooters, *PLoS Biol.*, 4:1079-1092 (2006).

Young et al., Chemical defense and aposematic coloration in larvae of the ascidian *Ecteinascidia turbinata*, *Mar. Biol.*, 96:539-544 (1987).

Zheng et al., Stereospecific formal total synthesis of ecteinascidin 743, *Angew. Chem. Int. Ed. Engl.*, 45:1754-1759 (2006).

\* cited by examiner

| | | | | | |
|---|---|---|---|---|---|
| EtuP1 | 2.0 | 51 | 69 | proteobacteria | (NP930029) | Pyruvate dehydrogenase E1 component |
| EtuP2 | 1.0 | 26 | 47 | | PRK11856 (ZP_06439425) | Pyruvate dehydrogenase E2 component |
| EtuR1 | 0.9 | 32 | 59 | proteobacteria | S29x(AAB39275) HMPREF0446_00485 | Bacterial symbiont gene for protein found in host |
| EtuR2 | 0.3 | 34 | 58 | bacteria | (ZP_05851657) | Transcriptional regulator MerR family |

Figure 2B

Figure 4A:
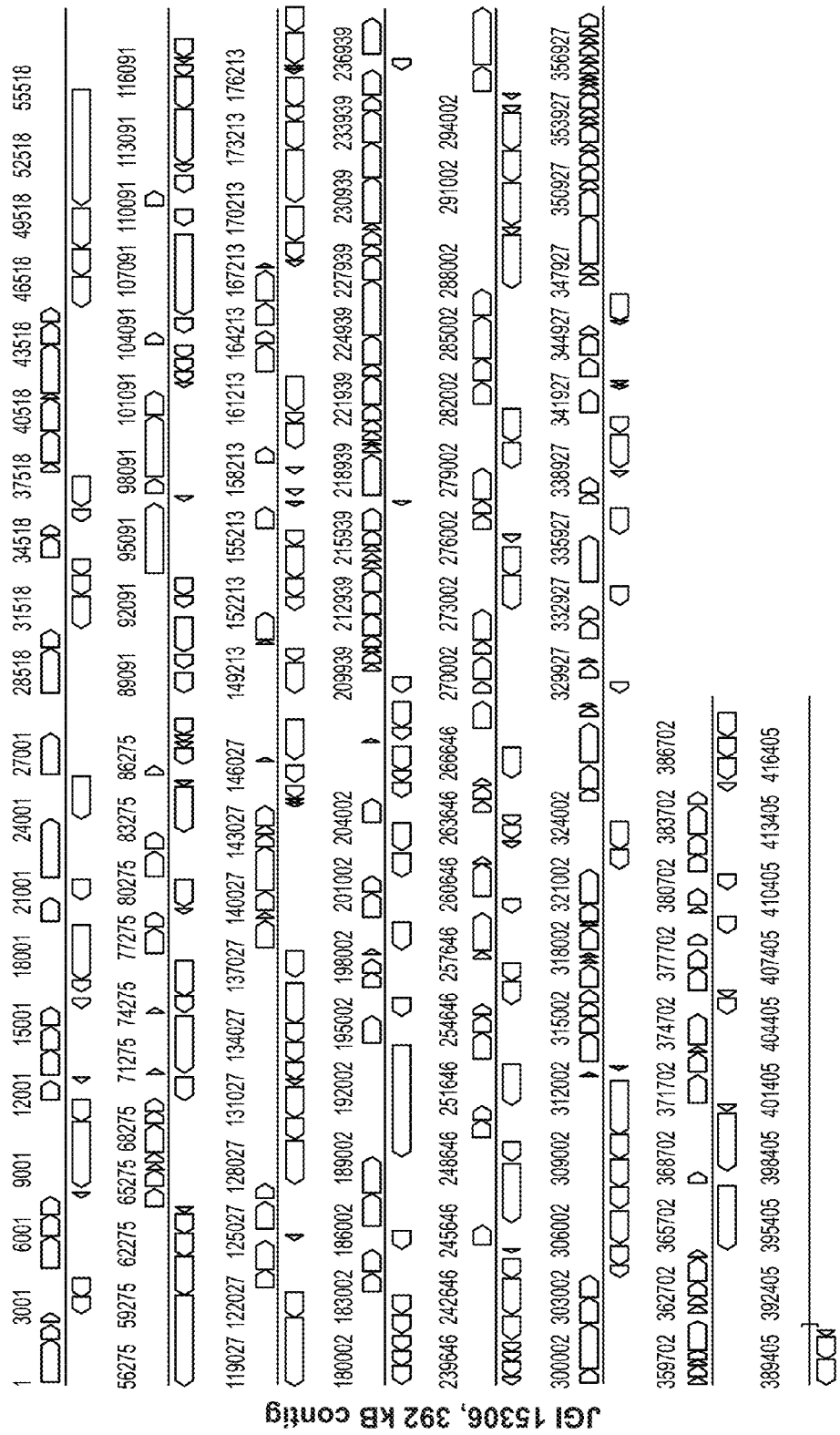

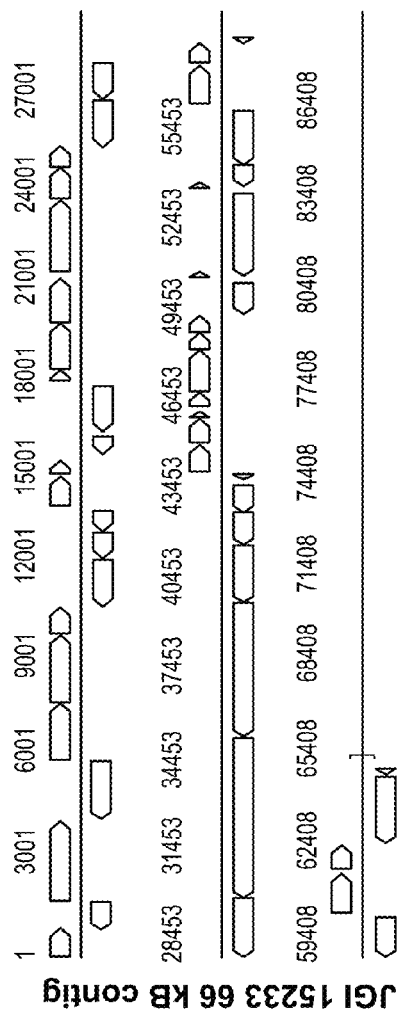
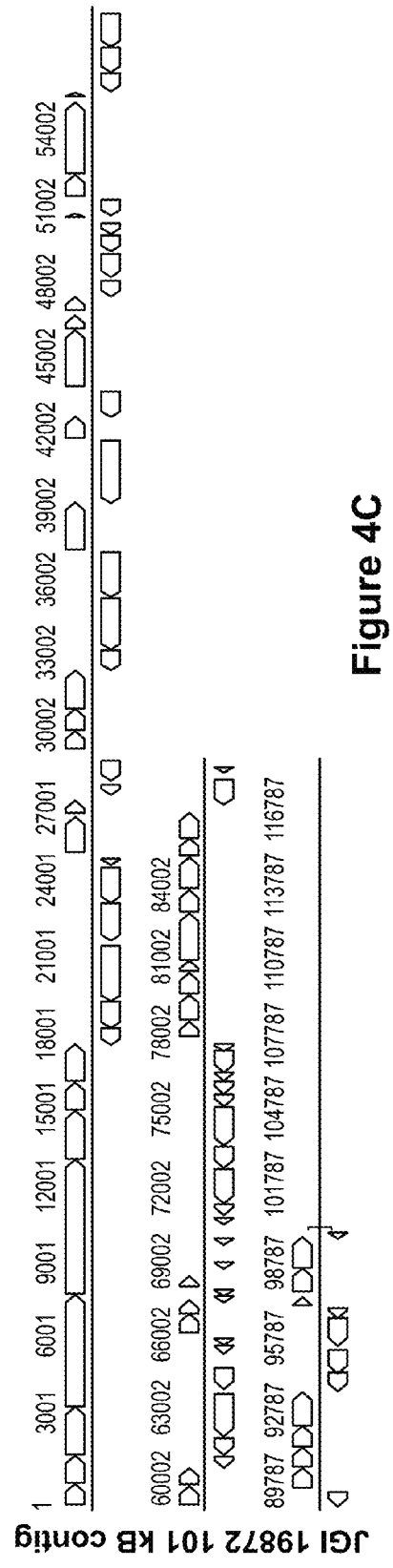
Figure 4B
Figure 4C

Figure 8A  Figure 8B

NONRIBOSOMAL PEPTIDE SYNTHETASES

CROSS REFERENCE TO RELATED APPLICATIONS

This application is a continuation-in-part application of U.S. patent application Ser. No. 14/603,032 filed Jan. 22, 2015 which, in turn, claims the priority benefit under 35 U.S.C. §119(e) of Provisional U.S. Patent Application No. 61/930,166, filed Jan. 22, 2014, the disclosures of which are incorporated herein by reference in their entireties.

STATEMENT OF GOVERNMENT INTEREST

This invention was made with government support under TW007404 awarded by the National Institutes of Health and DGE1256260 awarded by the National Science Foundation. The Government has certain rights in the invention.

INCORPORATION BY REFERENCE OF MATERIALS SUBMITTED ELECTRONICALLY

This application contains, as a separate part of disclosure, a Sequence Listing in computer readable form (Filename: 48175B_Seqlisting.txt; created May 14, 2015; 1,830,741 bytes), which is incorporated herein by reference in its entirety.

BACKGROUND OF THE INVENTION

Nonribosomal peptide synthetases (NRPSs) are large multidomain enzymes responsible for the biosynthesis of many pharmacologically important bioactive compounds of great structural diversity [Marahiel et al., *Chem. Rev. (Washington, D.C.)* 97: 2651-2673 (1997); Schwarzer et al., *Nat. Prod. Rep.* 20: 275-287 (2003); Cane et al., *Science* 282, 63-68 (1998)]. Prominent examples are the antibiotics penicillin, vancomycin, and actinomycin D, the immunosuppressant cyclosporine A, the siderophore enterobactin, and the antitumor drug bleomycin. NRPSs are organized into distinct modules, each of them responsible for the incorporation of one amino acid into the nascent peptide chain. A module can be further subdivided into catalytic domains, which are responsible for the coordinated recognition and activation [adenylation (A) domain] [Stachelhaus et al., *Chem. Biol.* 6: 493-505 (1999)], covalent binding and transfer [peptidyl carrier protein (PCP) domain] [Stachelhaus et al., *Chem. Biol.* 3: 913-921 (1996)], and incorporation [condensation (C) domain] of a certain substrate amino acid into the peptide chain [Stachelhaus et al., *J. Biol. Chem.* 273: 22773-22781 (1998)]. In addition to these so-called core domains, optional domains catalyze the modification of incorporated residues, i.e., by epimerization (E) or N-methylation (MT) domains [Walsh et al., *Curr. Opin. Chem. Biol.* 5: 525-534 (2001)]. Product release is normally effected by a thioesterase (Te) domain, catalyzing the formation of linear, cyclic, or branched cyclic products, representative for the class of NRPSs [Trauger et al., *Nature* 407: 215-218 (2000)].

Because of the modular organization of NRPSs and the colinearity between biosynthetic template and product, the NRP assembly line mechanism accommodates an enormous potential for biocombinatorial approaches. Little is known about the intermolecular communication between NRPSs within the same biosynthetic complex [Hahn et al., *Proceeding of the National Academy of Sciences (USA)* 101(44): 15585-15590 (2004)].

Ecteinascidin 743 (ET-743, trabectedin, Yondelis®) is a chemotherapeutic natural product isolated from the Caribbean mangrove tunicate *Ecteinascidia turbinata*. (1) The compound has been designated an orphan drug in the United States and Europe for the treatment of soft tissue sarcoma and ovarian cancer, and it is currently undergoing phase II clinical trials for breast and pediatric cancers and phase III trials for soft tissue sarcoma. Previous work suggests that the drug is actually produced by the uncultivable bacterial symbiont Candidatus *Endoecteinascidia frumentensis*. Bacterial symbionts like *E. frumentensis* have long been proposed to be responsible for the production of biomedically intriguing natural products isolated from sessile invertebrate animals. However, the general inability to culture these organisms in the laboratory severely hinders the study of their biosynthetic pathways and the ability harness the full potential of their natural products. Although *E. frumentensis* remains incapable of being cultured in the laboratory, the chemotherapeutic potential of ET-743 has fueled over two decades of research since the compound's original discovery and isolation. The wealth of information provided in these studies in combination with the similarity of ET-743 to three well-characterized compounds derived from cultivable bacteria makes *E. turbinata* an ideal model system to develop a repertoire of tools to facilitate the study of uncultivable bacterial symbiont natural products.

Previous studies suggest that the ET-743 producer, *E. frumentensis* is actually an endosymbiont, living within tunicate host's cells. This hypothesis is supported by phylogenetic analysis depicting the intracellular pathogen *Coxiella burnetii* as a close relative of *E. frumentensis*. Furthermore, a previous study examining the location of the bacteria at different stages in the host's life cycle also suggested the producer to be an endosymbiont Moss et al., Mar Biol. 143: 99-110 (2003). Microscopic analysis of probe-stained cells and tissue revealed no lysing of the bacteria, no host pathology, and no endocytic markers, suggesting the bacteria's presence within the host cell was symbiotic in nature.

Obtaining sufficient amounts of ET-743 has presented a challenge since it was first isolated in 0.0001% yield from the natural source [Rinehart et al., The Journal of Organic Chemistry 55: 4512-4515 (1990)]. Aquaculture has proven to be viable [Fusetani N (ed.): Drugs from the Sea. Basel. Karger. 2000. pp 120-133. Chapter: Dominick Mendola Aquacultural Production of Bryostatin 1 and ecteinascidin 743; Fusetani, Drugs from the Sea. (2000); Carballo, *Journal of the World Aquaculture Society* 31: 481 (2000)], although not an economical method for supplying ET-743 for clinical trials and commercial use [Cuevas, *Natural product reports* 26: 322 (2009)]. Total synthesis of ET-743 was first reported [Corey et al., *Journal of the American Chemical Society* 118: 9202-9203 (1996)] and further routes of synthesis have been published [Endo et al., *Journal of the American Chemical Society* 124: 6552-6554 (2002), Chen et al., *Journal of the American Chemical Society* 128: 87-89 (2005), Zheng et al., *Angewandte Chemie. International edition in English* 45: 1754 (2006), and Fishlock et al., *The Journal of Organic Chemistry* 73: 9594-9600 (2008)]. Commercial production by PharmaMar has used a semi-synthetic scheme in which cyanosafracin B is transformed into ET-743 over eight steps [Cuevas et al., *Organic Letters* 2: 2545-2548 (2000)] as safracin B can be cultured on the kilogram scale from the wild-type producer *Pseudomonas fluorescens* [Ikeda, *Journal of Antibiotics*. Series B 36: 1290 (1983)]. The structural similarity of ET-743 to the tetrahydroisoquinoline alkaloid natural products saframycin C, saframycin MX1 and cyanosafracin (see Scheme 1, below), each derived from three distinct cultivable bacteria, indicated a prokaryotic origin for the tunicate-derived metabolite.

Scheme 1. The chemotherapeutic compound ET-743 (1) and three natural products from cultivable bacteria that share a similar tetrahydroisoquinoline core.

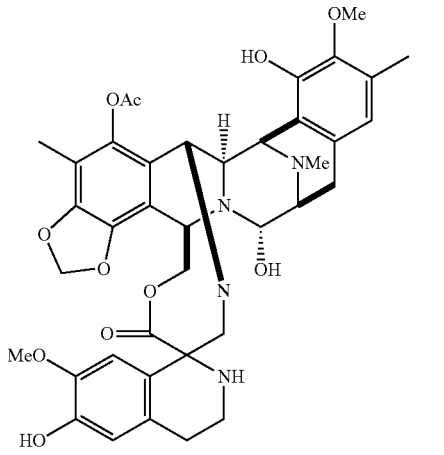

ET-743 (1)
*Endoecteinascida frumentensis*

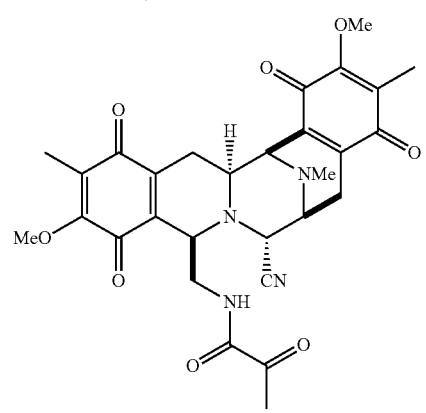

Saframycin A (2)
*Streptomyces lavendulae*

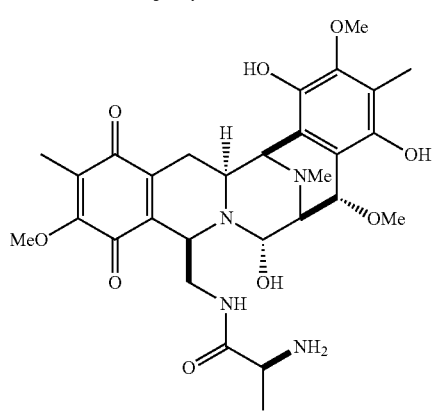

Saframycin Mx1 (3)
*Myxococcus xanthus*

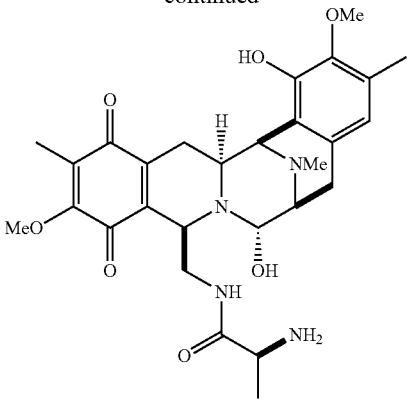

Safracin (4)
*Pseudomonas fluorescens*

SUMMARY OF THE INVENTION

Figure 5A:
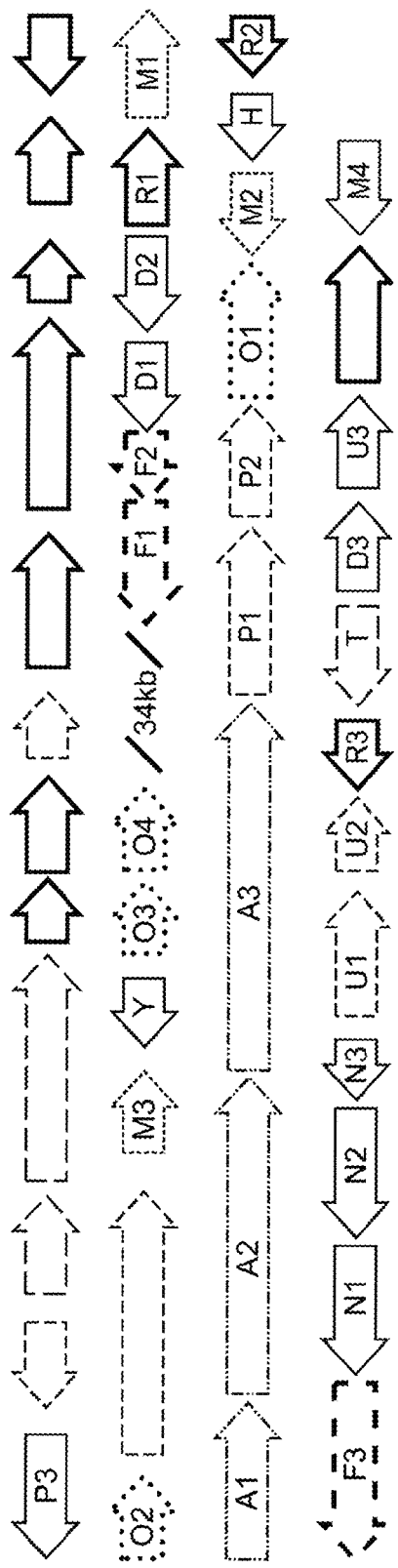
Figure 5B:
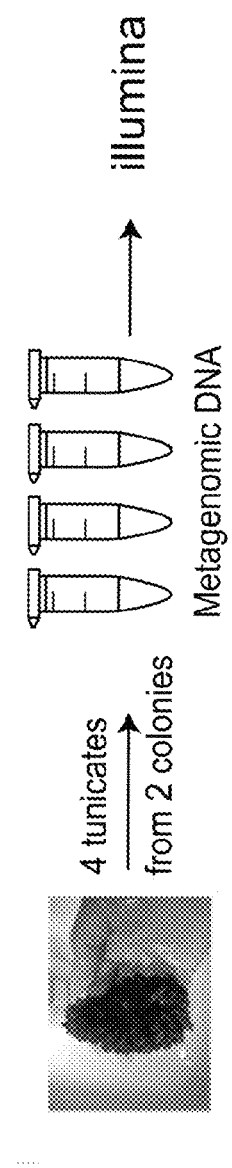

Next generation sequencing technologies were used to identify and sequence the complete biosynthetic gene cluster of the endosymbiont Candidatus *Endoecteinascidia frumentensis*, a gammaproteobacterium, encoding the enzymes in the biosynthetic pathway for ET-743. A 35 kb portion of the ET-743 biosynthetic gene (FIG. 1A) cluster using a combination of 454 based FLX and titanium pyro sequencing with metagenomic tunicate DNA was identified (Rath et al., ACS Chem. Biol. 6(11): 1244-1256 (2011); see also U.S. Pat. No. 8,815,562, which is incorporated by reference herein in its entirety). To complete the cluster, metagenomic DNA was isolated from four tunicates derived from an *E. turbinata* colony collected in the Florida Keys (FIG. 1B; FIG. 5B). Illumina sequencing was performed in conjunction with the Joint Genome Institute (JGI). The 35 kb gene cluster was used to mine the sequencing data provided herein, approximately 322 kb located upstream of the 35 kb cluster, and 70 kb located downstream. More specifically, Illumina sequencing was performed with three separate tunicates from three colonies collected in the Florida Keys. Each run returned a contig containing the previously identified 35 kb biosynthetic gene cluster (FIG. 4, rectangular boxes). Each of the three sequenced metagenomes possesses a contig containing at least a portion of the cluster located downstream. These three contigs (endosymbiont samples 1, 2, and 4) were assembled into a 427 kb scaffold (SEQ ID NO: 1)

Figure 1B:
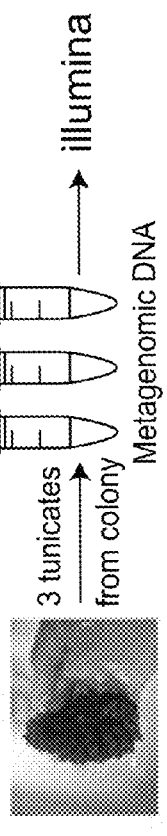

The 35 kb gene cluster was then further used to mine the sequencing data provided herein, thus yielding the complete genome (631 kilobases (kb); Appendix A) for the microbial producer of ET-743. More specifically, Illumina sequencing was performed with four separate tunicates isolated from two colonies collected in the Florida Keys. These four samples (endosymbiont samples 1, 2, 3, and 4) were combined and gaps were filled to construct a complete genome for the microorganism (Appendix A herein). Deep annotation to either side of the original 35 kb gene cluster resulted in what appears to be a 108 kb biosynthetic gene cluster (FIGS. 1B and 5A). The extended cluster contains genes encoding a methyltransferase, a monoxygenase, flavin enzymes, an acetyltransferase, fatty acid biosynthetic enzymes, and phosphopantetheine arm biosynthetic enzymes (FIG. 5A). The completed biosynthetic gene cluster is contemplated herein for use in biochemical and heterologous expression experiments in cultivable host organisms for ET-743 biosynthesis and production of biosynthetic precursors.

Disclosed herein are polynucleotide and polypeptide sequences derived from the microbiome of *E. turbinata* that are involved in a biosynthetic pathway to synthesize ET-743. Polynucleotides, CDS regions and complements thereof, CDS motifs and complements thereof, polypeptides encoded by polynucleotides, CDS regions and complements thereof, CDS motifs and complements thereof are set out in Appendix A hereto and identified by numbering based on SEQ ID NO: 1.

The present disclosure provides a method for synthesizing ET-743, an analog of ET-743, or a metabolic intermediate in the ET-743 synthetic pathway, in a host cell comprising the step of culturing a host cell of the present disclosure under conditions suitable to produce ET-743. Methods are provided wherein a host cell transformed with one or more expression vectors, encoding one or more polypeptides of the present disclosure, produces an intermediate compound in the synthesis of ET-743. In some aspects of the method, the intermediate is isolated. In various other aspects of the method, the intermediate is used to complete synthesis of ET-743. The synthesis method is, in various aspects, completed in the same host cell. In other aspects, the synthesis method is completed in a different host cell. In further aspects, methods are provided wherein the different host cell is transformed with one or more expression vectors encoding one or more polypeptides that are useful for the completion of the synthesis. The polypeptides are, in some aspects, any of the polypeptides described herein, and in some aspects are heterologous polypeptides that catalyze the same or similar steps in the biosynthetic pathway. It will be understood by those of ordinary skill in the art that polypeptides from genetically related or unrelated organisms may have the same or similar enzymatic capabilities as those disclosed herein. Accordingly, it is contemplated that such polypeptides may be used in combination with the polypeptides described herein in the synthesis of ET-743.

In some embodiments, the host cell comprises one or more heterologous polynucleotides. In some aspects, one or more heterologous polynucleotides are present in a single expression vector. As used herein, "expression vector" refers to a polynucleotide sequence capable of directing expression of a particular polynucleotide sequence in an appropriate host cell, including a promoter operably linked to the polynucleotide sequence of interest, which is optionally operably linked to 3' sequences, such as 3' regulatory sequences or termination signals. In some aspects, an expression vector also includes sequences required for proper translation of the polynucleotide sequence if any such sequences are needed. In another aspect, the host cell comprises more than one expression vector, wherein each expression vector encodes a different protein. In various aspects, a transformed host cell comprises one, two, three or more expression vectors. In various aspects, a host cell is transformed with 1, 2, 3, 4, 5, 6, 7, 8, 9, 10, 11, 12, 13, 14, 15 or all of the polynucleotides identified herein. Suitable host cells are known to those of ordinary skill in the art. Illustrative host cells include prokaryotic, yeast, avian, fungal, insect, mammalian, and plant cells. Prokaryotic host cells contemplated herein include without limitation *E. coli*, *Streptomyces lavendulae*, *Myxococcus xanthus*, and *Pseudomonas fluorescens*. *E. coli* host cells contemplated herein include without limitation laboratory and/or industrial strains of *E. coli* cells, such as BL21 or K12-derived strains (e.g., C600, DH1α, DH5α, HB101, INV1, JM109, TB1, TG1, and XL-1Blue).

"Sequence identity" means that two amino acid or polynucleotide sequences are identical over a region of comparison, such as for example and without limitation, a region of at least about 250 residues or bases. Optionally, the region of identity spans at least about 25-500 residues or bases, and spans the active domain of the polypeptide. Several methods of conducting sequence alignment are known in the art and include, for example, the homology alignment algorithm (Needleman & Wunsch, *J. Mol. Biol.*, 48, 443 (1970)); the local homology algorithm (Smith & Waterman, *Adv. Appl. Math.*, 2, 482 (1981)); and the search for similarity method (Pearson & Lipman, *Proc. Natl. Acad. Sci. USA*, 85, 2444 (1988)). The algorithm used to determine percent sequence identity and sequence similarity is in various aspects the BLAST algorithm (Altschul et al., *J. Mol. Biol.*, 215, 403-410 (1990); Henikoff & Henikoff. *Proc. Natl. Acad. Sci. USA*, 89, 10915 (1989); Karlin & Altschul, *Proc. Natl. Acad. Sci. USA*, 90, 5873-5787 (1993)). Software for performing BLAST analyses is publicly available through the National Center for Biotechnology Information. Other examples of alignment software, including GAP, BESTFIT, FASTA, PILEUP, and TFASTA provided by Wisconsin Genetics Software Package (Genetics Computer Group, 575 Science Dr., Madison, Wis.), and CLUSTALW (Thompson et al., *Nuc. Acids Res.*, 22, 4673-4680 (1994); http://www.ebi.ac.uk/Tools/clustalw2/index.html), are known in the art. The degree of homology (percent identity) between a native and a mutant sequence may be determined, for example, by comparing the two sequences using computer programs commonly employed for this purpose. Briefly, the GAP program defines identity as the number of aligned symbols (i.e., nucleotides or amino acids) which are identical, divided by the total number of symbols in the shorter of the two sequences. The default parameters for the GAP program include: (1) a unary comparison matrix (containing a value of 1 for identities and 0 for non-identities) for nucleotides, and the weighted comparison matrix of Gribskov and Burgess, Nucl. Acids Res. 14:6745, 1986, as described by Schwartz and Dayhoff, eds., Atlas of Protein Sequence and Structure, National Biomedical Research Foundation, pp. 353-358, 1979; (2) a penalty of 3.0 for each gap and an additional 0.10 penalty for each symbol in each gap; and (3) no penalty for end gaps.

Alterations of the native amino acid sequence may be accomplished by any of a number of known techniques. Mutations can be introduced at particular loci by synthesizing oligonucleotides containing a mutant sequence, flanked by restriction sites enabling ligation to fragments of the native sequence. Following ligation, the resulting reconstructed sequence encodes an analog having the desired amino acid insertion, substitution, or deletion.

Alternatively, oligonucleotide-directed site-specific mutagenesis procedures can be employed to provide an altered gene having particular codons altered according to the substitution, deletion, or insertion required. Techniques for making such alterations include those disclosed by Walder et al. (Gene 42:133, 1986); Bauer et al. (Gene 37:73, 1985); Craik (BioTechniques, January 1985, 12-19); Smith et al. (Genetic Engineering: Principles and Methods, Plenum Press, 1981); and U.S. Pat. Nos. 4,518,584 and 4,737,462, which are incorporated by reference herein.

Embodiments of the disclosure include:
1. The polynucleotide set out in SEQ ID NO: 1.
2. A polynucleotide comprising a CDS in SEQ ID NO: 1.

3. A polynucleotide comprising a CDS complement in SEQ ID NO: 1.

4. A polynucleotide comprising a CDS motif in SEQ ID NO: 1.

5. A polynucleotide comprising a CDS motif complement in SEQ ID NO: 1.

6. A polynucleotide 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identical to the polynucleotide of any one of paragraphs 2-5.

7. A polypeptide encoded by the polynucleotide of any one of paragraphs 2-6.

8. A polypeptide 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identical to the polypeptide of paragraph 7.

9. A vector comprising the polynucleotide of any one of paragraphs 1-6.

10. The vector of paragraph 9 which is an expression vector.

11. A host cell comprising the polynucleotide of any one of paragraphs 1-6 and/or the vector of paragraph 9 or 10.

12. A method of expressing the polypeptide of paragraph 7 or 8 comprising the step of growing the host cell of paragraph 11 under conditions appropriate to express the polypeptide.

13. An in vitro modification system comprising the polypeptide of paragraph 7 or 8.

Another aspect of the disclosure provides a method for producing ET-743 or a metabolic intermediate thereof comprising growing a host cell transformed with one or more expression vectors comprising a polynucleotide encoding one or more polypeptides selected from the group consisting of SEQ ID NOs: 421, 288, 289, 290, 291, 420, 350, 423, 425, 427, 429, 431, 433 and 435 under conditions to express the one or more polypeptides and producing ET-743 or the metabolic intermediate for producing ET-743. The sequence identifiers correspond to the amino acid sequences of the following polypeptides: O-methyltransferase (SEQ ID NO:288), Carbonic anhydrase/acetyltransferase (SEQ ID NO:289), Flavoprotein (SEQ ID NO:290), Pantothenate metabolism flavoprotein (SEQ ID NO:291), Methyltransferase domain (SEQ ID NO:350), Flavodoxin reductase (ferredoxin-NADPH reductase) family 1 (SEQ ID NO:420), NADPH-glutathione reductase (SEQ ID NO:421), EtuF4 (birA, biotin-[acetyl-CoA-carboxylase] ligase region; SEQ ID NO:423), EtuF5 (3-hydroxyacyl-[acyl-carrier-protein] dehydratase; SEQ ID NO:425), EtuF6 (phosphate:acyl-[acyl carrier protein] acyltransferase; SEQ ID NO:427), EtuF7 (malonyl CoA-acyl carrier protein transacylase; SEQ ID NO:429), EtuF8 (3-oxoacyl-[acyl-carrier-protein] reductase; SEQ ID NO:431), EtuF9 (acyl carrier protein; SEQ ID NO:433), and EtuF10 (β-ketoacyl-acyl-carrier-protein synthase II; SEQ ID NO:435). In some embodiments, each of the one or more polypeptides is selected from the group consisting of SEQ ID NOs: 421, 288, 289, 290, 291, 420 and 350. In some embodiments, ET-743 or the metabolic intermediate thereof is isolated. The disclosure also comprehends the method further comprising converting the intermediate to ET-743. Some embodiments of the method are practiced wherein the producing is completed in the same host cell.

The disclosure also contemplates methods wherein the host cell is transformed with at least one expression vector encoding at least one heterologous polypeptide comprising a catalytic activity in the biosynthetic pathway of ET-743 exhibited by any one of SEQ ID NOs: 421, 288, 289, 290, 291, 420, 350, 423, 425, 427, 429, 431, 433, or 435. In some embodiments, the host cell is transformed with at least one expression vector encoding at least one heterologous polypeptide comprising a catalytic activity in the biosynthetic pathway of ET-743 exhibited by any one of SEQ ID NOs: 421, 288, 289, 290, 291, 420, or 350. In some embodiments, the host cell is a prokaryotic host cell, such as *Pseudomonas fluorescens*. In some embodiments, the host cell comprises a polynucleotide encoding a first polypeptide of SEQ ID NO: 421, 288, 289, 290, 291, 420, 350, 423, 425, 427, 429, 431, 433, or 435. This aspect of the disclosure also contemplates methods wherein the host cell further comprises a polynucleotide encoding a second polypeptide of SEQ ID NO: 421, 288, 289, 290, 291, 420, 350, 423, 425, 427, 429, 431, 433, or 435, wherein the first and second polypeptides are different. Further contemplated are embodiments wherein the host cell further comprises a polynucleotide encoding a third polypeptide of SEQ ID NO: 421, 288, 289, 290, 291, 420, 350, 423, 425, 427, 429, 431, 433, or 435, wherein the first, second, and third polypeptides are different. Further contemplated are embodiments wherein the host cell further comprises a polynucleotide encoding a fourth polypeptide of SEQ ID NO: 421, 288, 289, 290, 291, 420, 350, 423, 425, 427, 429, 431, 433, or 435, wherein the first, second, third and fourth polypeptides are different. Further contemplated are embodiments wherein the host cell further comprises a polynucleotide encoding a fifth polypeptide of SEQ ID NO: 421, 288, 289, 290, 291, 420, 350, 423, 425, 427, 429, 431, 433, or 435, wherein the first, second, third, fourth and fifth polypeptides are different. Further contemplated are embodiments wherein the host cell further comprises a polynucleotide encoding a sixth polypeptide of SEQ ID NO: 421, 288, 289, 290, 291, 420, 350, 423, 425, 427, 429, 431, 433, or 435, wherein the first, second, third, fourth, fifth and sixth polypeptides are different.

Another aspect of the disclosure is drawn to an expression vector comprising a polynucleotide encoding one or more polypeptides selected from the group consisting of SEQ ID NOs: 421, 288, 289, 290, 291, 420, 350, 423, 425, 427, 429, 431, 433 and 435.

Yet another aspect of the disclosure is a host cell transformed with the expression vector disclosed herein. A related aspect of the disclosure provides a kit comprising the host cell described above and a protocol for producing ET-743 or an intermediate thereof.

Still another aspect of the disclosure is an isolated polypeptide comprising a catalytic activity in the biosynthetic pathway of ET-743, wherein the polypeptide is at least 95% and less than 100% identical to a polypeptide of SEQ ID NO: 421, 288, 289, 290, 291, 420, 350, 423, 425, 427, 429, 431, 433, or 435.

In another aspect of the disclosure, a method for producing ET-743 or a metabolic intermediate thereof is provided, comprising growing a host cell transformed with one or more expression vectors comprising a polynucleotide encoding one or more polypeptides selected from the group consisting of SEQ ID NOs: 421, 288, 289, 290, 291, 420, and 350 under conditions to express the one or more polypeptides and producing ET-743 or the metabolic intermediate for producing ET-743.

In some embodiments, ET-743 or the metabolic intermediate thereof is isolated. In further embodiments, the intermediate is converted to ET-743. In still further embodiments, the producing is completed in the same host cell. In related embodiments, the host cell is transformed with at least one expression vector encoding at least one heterologous polypeptide comprising a catalytic activity in the biosynthetic pathway of ET-743 exhibited by any one of SEQ ID NOs: 421, 288, 289, 290, 291, 420, or 350.

The disclosure also provides embodiments in which the host cell is a prokaryotic host cell. In related embodiments, the prokaryotic host cell is Escherichia coli or Pseudomonas fluorescens.

In some embodiments, the host cell comprises a polynucleotide encoding a first polypeptide of SEQ ID NOs: 421, 288, 289, 290, 291, 420, or 350. In some embodiments, the host cell further comprises a polynucleotide encoding a second polypeptide of SEQ ID NOs: 421, 288, 289, 290, 291, 420, or 350, wherein the first and second polypeptides are different.

The disclosure also provides embodiments wherein the host cell further comprises a polynucleotide encoding a third polypeptide of SEQ ID NOs: 421, 288, 289, 290, 291, 420, or 350, wherein the first, second, and third polypeptides are different. In some embodiments, the host cell further comprises a polynucleotide encoding a fourth polypeptide of SEQ ID NOs: 421, 288, 289, 290, 291, 420, or 350, wherein the first, second, third and fourth polypeptides are different. In further embodiments, the host cell further comprises a polynucleotide encoding a fifth polypeptide of SEQ ID NOs: 421, 288, 289, 290, 291, 420, or 350, wherein the first, second, third, fourth and fifth polypeptides are different. In still further embodiments, the host cell further comprises a polynucleotide encoding a sixth polypeptide of SEQ ID NOs: 421, 288, 289, 290, 291, 420, or 350, wherein the first, second, third, fourth, fifth and sixth polypeptides are different.

In another aspect, the disclosure provides an expression vector comprising a polynucleotide encoding one or more polypeptides selected from the group consisting of SEQ ID NOs: 421, 288, 289, 290, 291, 420, and 350.

In a further aspect, a host cell transformed with an expression vector of the disclosure is provided. A kit comprising a host cell of the disclosure, and a protocol for producing ET-743 or an intermediate thereof, is provided in still further aspects.

In some aspects, the disclosure provides an isolated polypeptide comprising a catalytic activity in the biosynthetic pathway of ET-743, wherein the polypeptide is at least 95% and less than 100% identical to a polypeptide of SEQ ID NOs: 421, 288, 289, 290, 291, 420, or 350.

BRIEF DESCRIPTION OF THE DRAWING

FIGS. 1A-1C show the original 35 kb gene cluster and the extended 108 kb gene cluster bracketing a schematic of the sequencing procedure. FIG. 1A depicts the original 35 kb gene cluster identified from metagenomic tunicate DNA using a Roche 454 platform. Gene products are classified as fatty-acid enzymes, DNA processing, regulatory enzymes, methyltransferases, transketolases, monoxygenases, hydroxylases, amidotransferases, enzymes of unknown function, drug transport enzymes, or phosphopantetheine arm biosynthetic enzymes. FIG. 1B depicts a flow diagram of the acquisition of the additional metagenomic DNA from the tunicates using an Illumina platform. FIG. 1C shows that the extended 108 kb gene cluster contains additional biosynthetic enzymes, including flavin enzymes, several methyltransferase enzymes, and an acetyltransferase.

FIGS. 2A-2B show genetic endosymbiotic evidence for the ET-743 producer, Ca. *E. frumentensis*. Phylogenetic analysis reveals a close relationship between the ET-743 producer and the intracellular pathogen *Coxiella burnetii* (FIG. 2A). The ET-743 enzyme EtuR1 also has high sequence identity to a bacterial symbiont gene in the *Amoeba proteus* (FIG. 2B).

FIG. 3 depicts an example of an annotated contig from tunicate host DNA in endosymbiont samples 1, 2, and 4, respectively. Genes in black are ribosomal rRNA genes and serve as taxonomic markers.

FIGS. 4A-4C show the annotated sequences from three of the four Illumina sequenced tunicate samples collected in the Florida Keys. 4A-4C. Each run returned a contig containing the previously identified 35 kb biosynthetic gene cluster (rectangular boxes). Combining these contigs with other sequences provided the complete genome for the ET-743 producer and an expanded biosynthetic gene cluster.

FIGS. 5A-5B depicts the original 35 kb gene cluster (outlined in black) and a schematic showing the sequencing procedure. FIG. 5A shows the original 35 kb gene cluster identified from metagenomic tunicate DNA using a Roche 454 platform. Genes that are not highlighted are biosynthetic genes identified from Illumina sequencing of metagenomic DNA. Gene products are classified as fatty-acid enzymes, DNA processing, regulatory enzymes, methyltransferases, nonribosomal peptide synthetases, transketolases, monoxygenases/flavin enzymes, hydroxylases, amidotransferases, enzymes of unknown function, drug transport enzymes, or acetyltransferase enzymes. FIG. 5B shows the workflow for the acquisition of the additional metagenomic DNA from tunicates using an Illumina platform.

FIGS. 6A-6C depict the biosynthetic pathway for the chemotherapeutic compound ET-743. Gene products, including those from the original 35 kb cluster, work together to create the final compound. The single asterisk (*) indicates the transition from FIG. 6A to FIG. 6B, i.e., the product of FIG. 6A in the starting compound of FIG. 6B. The double asterisk () indicates the transition from FIG. 6B to FIG. 6C, i.e., FIG. 6B is the starting compound of FIG. 6**C.

FIGS. 7A-7D show a schematic of the complete ET-743 biosynthetic gene cluster. 7A. ET-743 biosynthetic genes were identified upstream and downstream of the original ET-743 biosynthetic gene cluster (outlined in black). Gene products are classified as pyruvate dehydrogenases, enzymes of unknown function, transport proteins, regulatory and primary metabolism enzymes, flavoenzymes, methyltransferases, acetyltransferases, fatty acid biosynthetic enzymes, DNA processing enzymes, and nonribosomal peptide synthetases, and hydroxylases. 7B-7D. A more current biosynthetic pathway for ET-743 than shown in FIG. 6A-6C.

FIGS. 8A-8C show tunicate colonies and compounds, including ET-743. 8A. Tunicate colonies growing on the root of a mangrove tree in the Florida Keys. 8B. A tunicate colony composed of individual zooids (indicated by arrow). The metagenomic DNA from four zooids was sequenced in the studies disclosed herein. 8C. The chemotherapeutic compound ET-743 (1) and three natural products from cultivable bacteria that share a similar tetrahydroisoquinoline core.

FIG. 9 provides a circular map of the closed genome of Candidatus *E. frumentensis*. The outermost circle displays protein-coding genes assigned to Pfam categories (see key). The dark grey and light grey circles display protein-coding genes on the plus strand and minus strands, respectively. The fourth circle depicts a histogram of G+C content throughout the genome. The innermost circle represents ET-743 biosynthetic genes. Genes previously identified are depicted in light red while putative new genes are shown in dark red.

FIG. 10 provides an overview of the metabolism of Ca. *E. frumentensis* deduced from genomic analysis. Reaction products depicted in red have either missing or partially missing biosynthetic pathways. ACP, acyl carrier protein; AICAR, 5-aminoimidazole carboxamide ribonucleotide; CoA, coenzyme A; DHAP, Dihydroxyacetone phosphate; DHF, dihydrofolate; DMAPP, dimethylallyl pyrophosphate; FAD, flavin adenine dinucleotide; FMN, flavin mononucleotide; IMP, inosine monophosphate; NAD, nicotinamide adenine dinucleotide; PRPP, phosphoribosyl pyrophosphate; THF, tetrahydrofolate; UMP, uridine monophosphate.

Figure 11:
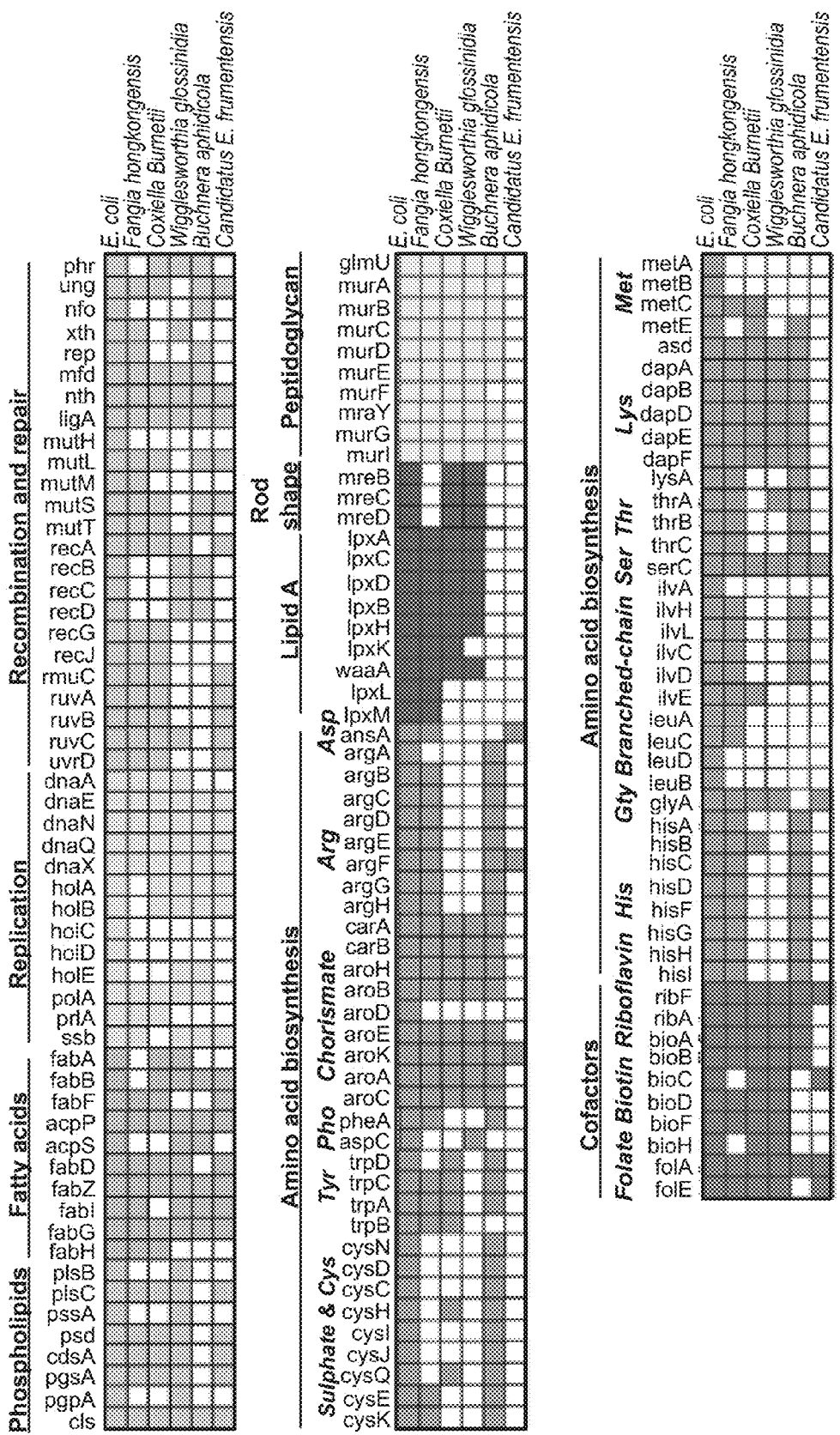

FIG. 11 shows the gene content of drastically reduced genomes. Shaded boxes represent the presence of a gene in the genome while white boxes represent its absence. The minimal gene content of Ca. E. frumentensis more closely resembles the reduced obligate symbiont genomes of B. aphidicola (NC_011834) and W. glossinidia (CP003315) than the intracellular pathogen C. Burnetii (NC_011528) or the free-living microorganisms F. hongkongensis (GCA_000379445.1) and E. coli (NC 000913).

DETAILED DESCRIPTION OF THE INVENTION

Disclosed herein are sequences and methods generated from next generation sequencing technologies to expand and complete the biosynthetic gene cluster of a NRPS-derived drug and uncover the complete genome of the microorganism responsible for ET-743 production. Analysis of phylogenetic markers and the protein-coding genes indicated that the microbe has a novel taxonomic rank higher than the species level. In-depth genomic analysis also provided initial insights into the endosymbiotic lifestyle of Candidatus Endoecteinascidia frumentensis, the ecological role of its singular secondary metabolic pathway, and key information that will provide access to host-cell free growth in the laboratory.

Accordingly, the disclosure provides a method for producing ET-743 or a metabolic intermediate thereof comprising growing a host cell transformed with one or more expression vectors comprising a polynucleotide encoding one or more polypeptides selected from the group consisting of SEQ ID NOs: 421, 288, 289, 290, 291, 420, and 350 under conditions to express the one or more polypeptides and producing ET-743 or the metabolic intermediate thereof, i.e., an intermediate in the production pathway for ET-743. Thus, in various embodiments, methods provided herein include, without limitation, use of an N-methyltransferase, a carbonic anhydrase/acetyltransferase, a flavoprotein, flavodoxin reductase (ferredoxin NADPH reductase), and a methyltransferase as described, e.g., in Table 4. Use of such gene products (as identified in SEQ ID NOs: 421, 288, 289, 290, 291, 420, and 350) are useful, in some embodiments, alone or in combination with previously disclosed Etu gene products (see U.S. Pat. No. 8,815,562, incorporated herein by reference in its entirety) for the production of a drug (for example and without limitation, ET-743) or an intermediate thereof.

The disclosure also contemplates use of a polypeptide 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identical in sequence to a polypeptide according to any of SEQ ID NOs: 421, 288, 289, 290, 291, 420, or 350. In alternative embodiments, the disclosure contemplates use of a polynucleotide encoding any of the polypeptides set out in SEQ ID NOs: 421, 288, 289, 290, 291, 420, or 350.

"Heterologous," as used herein, means of different natural origin or of synthetic origin. For example and without limitation, if a host cell is transformed with a polynucleotide sequence that does not occur in the untransformed host cell, that nucleic acid sequence is said to be heterologous with respect to the host cell. The transforming nucleic acid optionally includes, in various embodiments, a heterologous promoter, heterologous coding sequence, and/or heterologous termination sequence. Alternatively, the transforming polynucleotide in another embodiment, is completely heterologous or includes any possible combination of heterologous and endogenous polynucleotide sequences. The term "heterologous" applies to cells, including plant and bacterial cells, and also to plasmids, plastids, and viruses.

As used herein, "analog" means that a described compound shares a structural or functional characteristic with a parent compound from which it was derived or upon which its design was based, at least in part.

Figure 3:
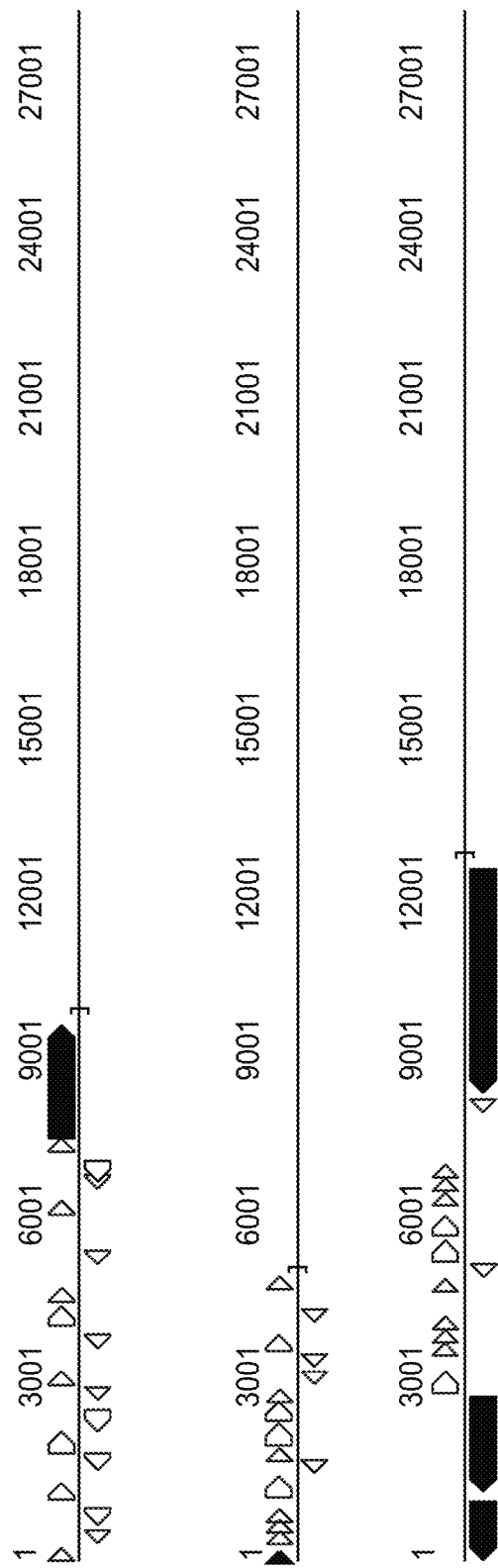

It is understood that the term "intermediate" as used means that a compound may be subjected to further processing steps, for example and without limitation as disclosed herein for the synthesis of ET-743. The term "intermediate" is used interchangeably with the term "metabolic intermediate" herein. FIG. 3 of U.S. Pat. No. 8,815,562, incorporated herein by reference, sets out a pathway for production of ET-743 with various intermediates in the synthetic pathway. Intermediates are contemplated without limitation for their immediate use, for isolation and storage for use at a later time, for use in the production of analogs, and as semi-synthetic precursors of the NRPS not limited to ET-743. In some embodiments, intermediates are contemplated for the production of semi-synthetic compounds that have antimicrobial, anticancer, and/or anti-inflammatory activity. The person of skill in the art will appreciate that intermediates as described herein are also useful in themselves, or useful for production of, for example, ET-743 by their modification in an in vitro system incorporating one or more isolated polypeptides as described both herein and in FIG. 3 of U.S. Pat. No. 8,815,562 that allow for production of ET-743. Alternatively, intermediates are used in vivo systems wherein a transformed host cell as described herein is capable of taking up the intermediate and further processing the intermediate to provide ET-743.

It is noted here that, as used in this specification and the appended claims, the singular forms "a," "an," and "the" include plural reference unless the context clearly dictates otherwise.

EXAMPLES

Example 1

Materials and Methods; Overview of Samples and Dataset

Sample Collection and Isolation of Metagenomic DNA. Two tunicate colonies were collected off the coast of the Florida Keys. Animals were immediately frozen on dry ice after collection and stored at −80° C. until processing. Metagenomic DNA was isolated from single zooids plucked from each colony following the protocol outlined for mouse tails in the Wizard Genomic DNA Purification Kit (Promega). Metagenomic DNA samples were shipped on dry ice to the Joint Genome Institute (JGI) for immediate sequencing.

Genome Sequencing, Assembly, Binning and Annotation. The four metagenomic samples were sequenced, assembled, and annotated by the U.S. Department of Energy's Joint Genome Institute (JGI IMG Submission IDs 15233, 15306, 19872, and 21664; Taxon Object IDs 3300001539, 3300001463, 3300001689, and 3300001913). Individual contigs from each raw assembly were then assigned to taxonomic groups through binning with tetranucleotide frequency with ESOM as described previously (Dick et al., Genome Biol 10:R85 (2009), incorporated herein by reference in its entirety). Because the metagenomes had an excess of sequences belonging to the eukaryotic host tunicate, iterative rounds of ESOM were required to hone in on microbial communities present in the sample.

Filling Genomic Gaps. Primers were designed to bind upstream of any suspected genomic gaps and PCR was carried out using KOD Xtreme™ Hot Start DNA Polymerase (Novagen). Reactions contained 0.02 U/µL polymerase, 1× of the supplied buffer, 0.3 µM custom primers, 0.4 mM each dNTP, and 100 ng of metagenomic DNA. Reactions consisted of a hot start (94° C., 2 minutes), followed by 35 cycles of denaturing (98° C., 10 seconds), annealing (variable temperatures for 30 seconds), and extension (68° C. for variable times). Because the size of genomic gaps was not certain, a longer extension time of 5 minutes was used initially. If we saw a DNA band after running reactions on a 1% agarose gel, we repeated PCR and tailored the extension time to the size of the band (1 minute/kbp) to limit any nonspecific amplification. Amplified DNA was then isolated from agarose gels using the standard protocol from the Wizard® SV Gel and PCR Clean-Up Kit (Promega).

Samples were subjected to Sanger sequencing with the primers used in the PCR reactions. Primer walking along the DNA strand then provided the missing sequence within both gaps. The complete consensus genome was submitted to JGI IMG (Markowitz et al., 2014) for gene calling and annotation (JGI Submission ID: 62187; Analysis Project ID: Ga0072939). Genes from the previously identified ET-743 biosynthetic gene cluster (Rath et al., ACS Chem. Biol. 6(11): 1244-1256 (2011)) and the 16S gene for Ca. E. frumentensis (Pérez-Matos et al., Antonie Van Leeuwenhoek 92: 155-164 (2007); Moss et al., Mar Biol. 143: 99-110 (2003); Rath et al., ACS Chem. Biol. 6(11): 1244-1256 (2011) were used as BLAST queries to identify the bin containing the ET-743 producer in each of the four metagenomic samples. The four resulting bins were manually evaluated for completeness through the analysis of the distribution of conserved phylogenetic markers (Ciccarelli, Science 311: 1283-1287 (2006)). Contigs from the four bins were assembled into a consensus genome with Geneious (v. 7.1.3).

Genome Analysis. The common genes included in FIG. 11 were compiled from other studies examining genome reduction in endosymbionts and intracellular pathogens (Moran et al., 2008; Kwan et al., 2014). Analysis of primary metabolic pathways was completed using the KEGG and MetaCyc annotations provided through JGI/IMG. To confirm the absence of any missing genes, protein sequences from a model organism (typically from E. coli E12) were used as queries in a BLASTP search against the Ca. E. frumentensis annotated genome.

To detect pseudogenes, all intergenic regions larger than 100 bp were used as BLASTX queries against the entire NR database using default settings. Any hits with e-values lower than $1 \times 10^{-3}$ against nonhypothetical proteins were considered pseudogenes.

Figure 2A:
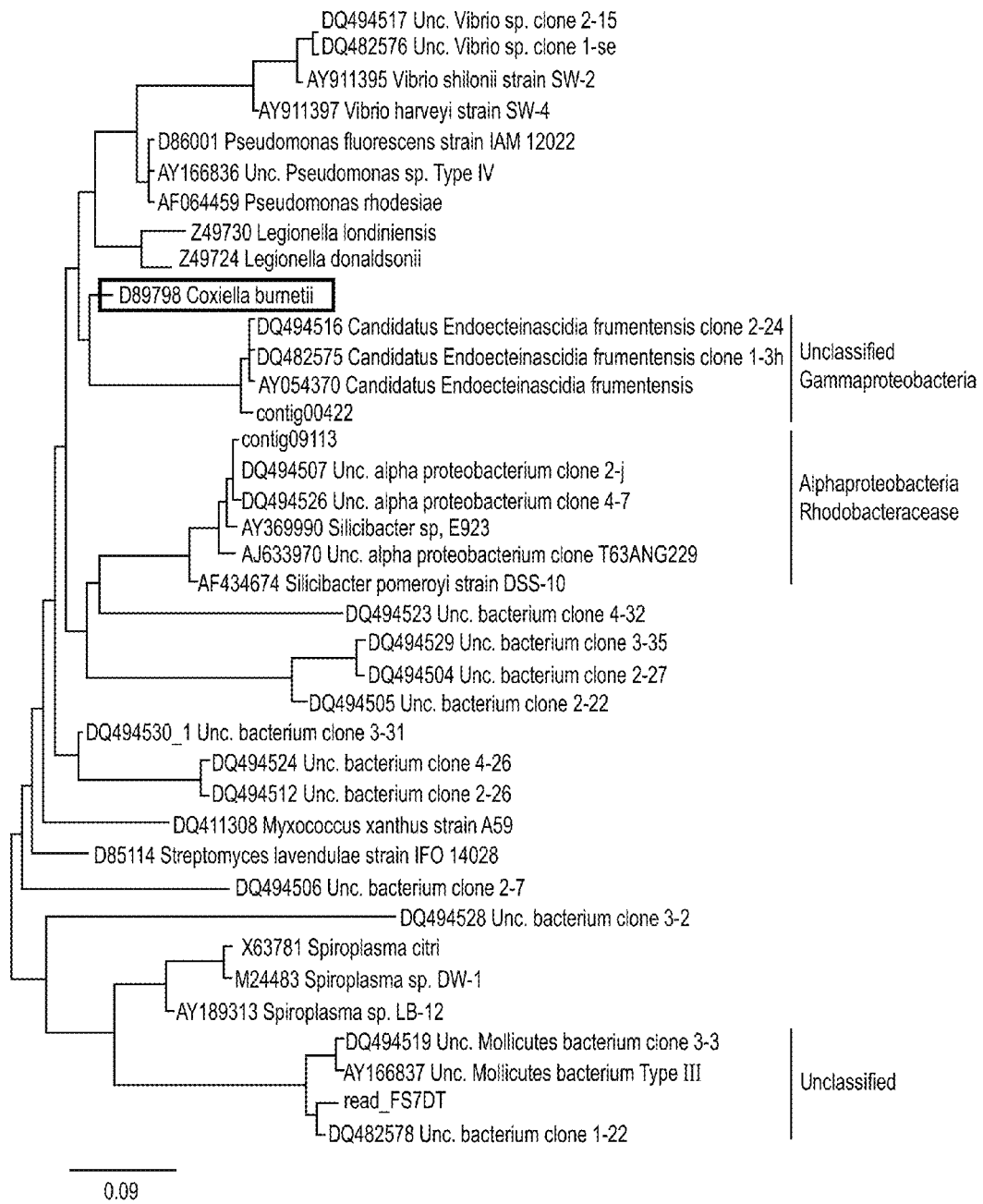

Visualization of the complete genome (FIG. 2) was constructed using Circos (Krzywinski et al., 2009). Data for circles displaying Pfam categories for protein-coding genes, genes on the plus strands, and genes on the minus strands were provided directly through JGI IMG annotations and analysis. To detect natural product gene clusters, the full genome was analyzed with a host of previously described bioinformatics tools, including antiSMASH 2.0 (Blin et al., 2013), NP.searcher (Li et al., 2009), CLUSEAN (Weber et al., 2009), BAGEL3 (van Heel et al., 2013), and 2metdb (Bachmann and Ravel, 2009).

Results and Observations. The colonies of E. turbinata consist of thick bundles of individual zooids connected by a network of stolons that enable adherence of the animal to a stable surface (Carballo et al., Journal of the World Aquaculture Society 31: 481-490 (2000)). Metagenomic DNA was previously isolated from individual zooids, uncovering a 35 kb gene cluster responsible for ET-743 biosynthesis using 454 pyrosequencing (Rath et al., ACS Chem. Biol. 6(11): 1244-1256 (2011)). Additional metagenomic DNA was isolated from four zooids obtained from two colonies. The resulting DNA samples were sequenced using Illumina HiSeq technology and the data were assembled into contigs in conjunction with the Joint Genome Institute (JGI). The four zooids provided metagenome datasets each containing over 800 Mbp of sequence (Table 1). Table 1 provides an overview of the four metagenomic datasets isolated from Ecteinascidia turbinata. A single genomic bin containing both the ET-743 biosynthetic gene cluster and the 16S rRNA gene for Candidatus Endoecteinascidia frumentensis was present in every metagenomic sample. Samples 19872 and 21664 also contained a bin with an rRNA marker for an Oscillatoriales species. Sample 21664 contained an additional prokaryotic bin from an unknown source.

TABLE 1

|  | 15233 | 15306 | 19872 | 21664 |
|---|---|---|---|---|
| Metagenome Detail | | | | |
| Total Assembled Bases | 808,986,041 | 839,356,773 | 847,549,657 | 837,783,164 |
| Longest Sequence | 97,417 | 391,789 | 163,783 | 171,962 |
| Shortest Sequence | 200 | 200 | 200 | 200 |
| Total Genes | 3,184,772 | 3,930,810 | 4,966,920 | 2,910,719 |
| 16S rRNA genes | 13 | 8 | 13 | 19 |
| Classified bins with rRNA marker | 1 | 1 | 2 | 3 |
| Candidatus E. frumentensis Bin Detail | | | | |
| Total Sequences | 24 | 5 | 13 | 7 |
| Total Bases | 662,683 | 636,675 | 635,600 | 635,519 |
| Longest Sequence | 40,233 | 391,789 | 87,220 | 167,454 |

TABLE 1-continued

|  | 15233 | 15306 | 19872 | 21664 |
|---|---|---|---|---|
| Mean Length | 27,612 | 127,335 | 48,892 | 90.503 |
| N50 | 40,233 | 391,789 | 87,220 | 167,454 |
| Shortest Sequence | 4,464 | 7,967 | 4,125 | 4,268 |
| Estimated Completeness | 100% | 100% | 100% | 100% |

The contigs were assigned and assembled to taxonomic bins using tetranucleotide frequency with emergent self-organizing maps (tetra-ESOM) as previously described (Dick et al., Genome Biol 10: R85 (2009)). Each of the four metagenomic samples possessed a single bin containing both the previously identified partial ET-743 biosynthetic gene cluster and the 16S rRNA gene for Ca. E. frumentensis (Table 1). The four bins containing the ET-743 producing microorganism were further assembled into a consensus genome containing three contigs. PCR amplification closed a 200 bp gap between two of the contigs to create a 630 kb scaffold. Additional PCR amplification closed a final 1.5 kb gap in the scaffold to create the closed genome for Ca. E. frumentensis (Table 1).

Coverage depth of the endosymbiont sequences reached approximately 200× over most of the genome, however, one of the two contigs possessed unique sequence signatures distinguishing it from the rest of the genome.

As noted, the coverage depth for most of the endosymbiotic genome averaged approximately 200×, however the contig excluded from the closed genome possessed distinguishing signatures. This much smaller, approximately 18 kb contig encodes a DNA primase and two protein-coding genes with ambiguous functions that repeat throughout the stretch of the sequence. Unlike the circular genome, the shorter contig has a coverage depth of only approximately 20× and reads could not be mapped to the sequence with confidence. The contig was also found along the edge of the bin for the ET-743 producer for all metagenomic samples, which introduced ambiguity regarding its authenticity. The contig could represent some type of lower abundance extrachromosomal DNA for Ca. E. frumentensis or it could be another genetic artifact that happens to bin with the endosymbiont. Thus, the analysis was focused on the closed Ca. E. frumentensis genome described herein.

Surprisingly, very few other bins linked to phylogenetic markers were detected in the metagenomic datasets despite prior evidence that the tunicate housed a complex microbial consortium (Table 1; Moss et al., Mar Biol. 143: 99-110 (2003); Rath et al., ACS Chem Biol 6: 1244-1256 (2011)). However, previous studies indicated Ca. E. frumentensis was one of the most abundant species in the consortium (Pérez-Matos et al., Antonie Van Leeuwenhoek 92: 155-164 (2007); Moss et al., Mar Biol. 143: 99-110 (2003); Rath et al., ACS Chem Biol 6: 1244-1256 (2011)) and the only microorganism found to be consistently associated with the tunicate host in both the Mediterranean and Caribbean marine habitats (Pérez-Matos et al., Antonie Van Leeuwenhoek 92: 155-164 (2007)). Thus, it is expected that the eukaryotic host and Ca. E. frumentensis microorganism monopolized the sequencing data despite the presence of a complex but lower abundance microbial community. The only other notable bin after tetra-ESOM was a cyanobacterium from the order Oscillatoriales that was present in two of the four metagenomic DNA samples (Table 1).

Example 2

Genome Reduction in the Symbiont

Previous in situ hybridization analysis provided an initial indication that Ca. E. frumentensis could be a bacterial endosymbiont (Moss et al., Mar Biol. 143: 99-110 (2003)). Assembly and analysis of the microbe's complete genome provided convincing evidence of an intracellular lifestyle and long-term evolution with the tunicate host, E. turbinata. Ca. E. frumentensis possesses many of the hallmarks of genome reduction, which is thought to be driven by a small bacterial population size and an inherent deletion bias (McCutcheon et al., Nat Rev Microbiol 10: 13-26 (2012); Moran, PNAS 93: 2873-2878 (1996); Moran et al., Annu Rev Genet 42: 165-190 (2008)). The circular genome for Ca. E. frumentensis is quite small, totaling only 631,345 kb. The small size of the genome rivals those of the model obligate endosymbionts Buchnera aphidicola in aphids and Wigglesworthia glossinidia in tsetse flies. The functions maintained by Ca. E. frumentensis are also consistent with the minimal gene sets observed in these and other obligate symbionts. For example, Ca. E. frumentensis appears to have lost a number of genes involved in DNA replication and repair mechanisms. The loss of DNA repair mechanisms is thought to be a crucial turning point during the evolution of an endosymbiont (McCutcheon et al., Nat Rev Microbiol 10: 13-26 (2012); Moran et al., Annu Rev Genet 42: 165-190 (2008)). Loss of these genes is frequently accompanied by increased mutation rates, an A+T DNA sequence bias, and the loss of additional nonessential genes.

The exceptionally low total G+C content (23.3%) of Ca. E. frumentensis genomic DNA supports a mutational bias and an obligate endosymbiotic lifestyle. The G+C content disparity between the coding (24.3%) and noncoding (13.4%) regions of the genome (Table 2) further exemplifies this bias. Bacterial lineages that only recently became restricted to a host organism often have higher numbers of pseudogenes within these noncoding regions and a consequently low overall coding density (Kuo et al., Genome Res 19: 1450-1454 (2009)). However, as bacteria continue to co-diversify with their hosts, pseudogenes gradually shrink and become unrecognizable through deletions while genomes become more compact (Moran, PNAS 93: 2873-2878 (1996); Mira et al., Trends Genet 17: 589-596 (2001); Kuo et al., Genome Biology and Evolution 1: 145-152 (2009)). The noncoding regions of the Ca. E. frumentensis genome have only 10 pseudogenes whose predicted translation products show amino acid sequence similarity to known proteins (Table 3). The genome also has a higher overall coding density of 90.7% (Table 2), similar to B. aphidicola, W. glossinidia, and other obligate endosymbionts that codiversified with their hosts along the order of millions of years (Moran et al., Annu Rev Genet 42: 165-190 (2008); Moran et al., Proc. R. Soc. Lond. B 253: 167-171 (1993); Chen et al., J Mol Evol 48: 49-58 (1999))). These data provide strong support that Ca. E. frumentensis is an obligate endosymbiont that has undergone long-term co-diversification with the tunicate host, *E. turbinata*.

TABLE 2

General features of the *Candidatus E. frumentensis* genome.

| Detail | *Candidatus E. frumentensis* |
|---|---|
| Genome Size (bp) | 631,335 |
| GC Content (%) | |
| Total | 23.3 |
| Coding Regions | 24.2 |
| Noncoding Regions | 12.7 |
| Coding Density (%) | 90.7 |
| Intergenic Pseudogenes | 10 |
| Protein-coding genes | 585 |
| With functional annotation | 556 (95.0%) |
| With ambiguous function | 29 (4.6%) |
| rRNA genes | 3 |
| tRNA genes | 32 |

TABLE 3

Pseudogenes identified in the noncoding regions of the *Ca. E. frumentensis* genome.

| | Coordinates | |
|---|---|---|
| Possible Past Gene Product | Start | End |
| Preprotein translocase subunit secY | 28,854 | 29,134 |
| Peptide chain release factor 2 | 194,322 | 194,757 |
| 4Fe—4S ferredoxin | 232,151 | 233,405 |
| FAD-linked oxidoreductase | 233,604 | 234,101 |
| tRNA pseudouridine synthase B | 279,113 | 279,276 |
| Aldehyde dehydrogenase | 396,212 | 397,484 |
| Dehydrogenase | 397,758 | 398,668 |
| Thymidylate kinase | 439535 | 439798 |
| Transcription-repair coupling factor | 577987 | 580330 |

Example 3

Phylogenetic Analysis of Ca. *E. frumentensis*

The draft genome of Ca. *E. frumentensis* appears unique from other studied microorganisms. Analysis of conserved markers indicated that Ca. *E. frumentensis* is phylogenetically unique compared to any previously characterized bacterial species. Comparative analysis of the 16 rRNA gene using BLASTN queries against the NT database revealed only a few close relatives, with the closest homologues for genes encoding the 16S rRNA gene, recA, and rpoB showing 84.7%, 72.2%, and 56.75% sequence identities, respectively. Phylogenetic trees were constructed using Geneious (v. 7.1.3) after ClustalW multiple alignments with an IUB cost matrix (default settings). Neighbor-joining trees were constructed with the Jukes-Cantor genetic distance model (default settings). Top hits for cultivable or well-studied uncultivable microorganisms were included in the phylogenetic tree for 16S rRNA gene sequences. Unique hits for rpoB and recA were used in respective genetic trees.

To further explore the phylogenetic uniqueness of Ca. *E. frumentensis*, the complete or draft genomes of the top hits from phylogenetic analyses were used in a two-way BLAST against Ca. *E. frumentensis* to acquire average amino acid identity (AAI), as previously described (Konstantinidis and Tiedje, 2005). Thresholds for unique taxonomic rankings were based on 16S rRNA gene sequence identity, as previously described (Yarza et al., 2014). This analysis indicated that Ca. *E. frumentensis* may have a novel taxonomic rank at least higher than the species level, and likely represents a new family of Gammaproteobacteria (FIG. 11).

Primary Metabolism—Central Metabolism and Carbon Sources

Figure 10:
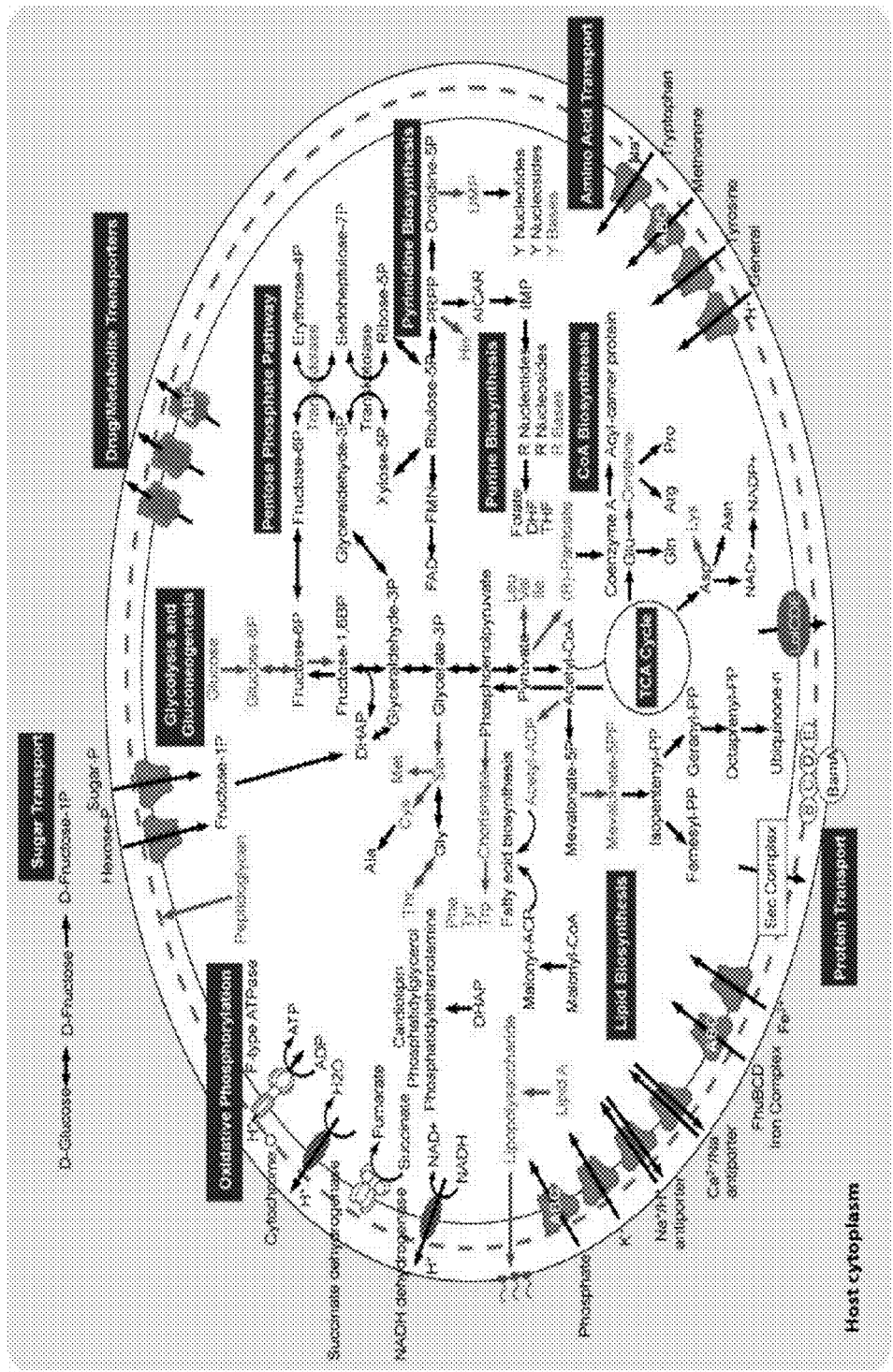

Analysis of primary metabolic pathways provided further insight into the lifestyle of the taxonomically distinct endosymbiont Ca. *E. frumentensis* and its relationship with the host tunicate. Despite the small size of the genome, Ca. *E. frumentensis* possesses portions of all three components of central metabolism. The tricarboxylic acid cycle (TCA cycle) is intact, as is most of the non-oxidative branch of the pentose phosphate pathway. The symbiont also has the majority of the genes involved in the glycolytic pathway and gluconeogenesis (FIG. 10). Interestingly, the genome is devoid of any genes encoding enzymes involved in early glucose breakdown. This is surprising since glucose is the preferred carbon source for many bacteria (Gorke et al., Nat Rev Microbiol 6: 613-624 (2008)). However, the symbiont may still be able to draw on sugar sources from the host for energy. The genome encodes two sugar phosphate transporters and enzymes for the remainder of the glycolytic pathway. Sugar phosphates can be important carbon sources for intracellular pathogens and endosymbionts, especially those present in the host cytosol (Munoz-Elias et al., Cell Microbiol 8: 10-22 (2006)). The symbiont possibly imports sugar phosphates from the host, including fructose-1-phosphate or more advanced sugar phosphate intermediates in the glycolytic or pentose phosphate pathways.

Electron Transport Chain

The symbiont genome also encodes the electron transport chain and an F-type ATPase. The respiratory chain likely obtains succinate and electron donors from the TCA cycle to generate an electrochemical gradient and produce ATP. Interestingly, cytochrome bo3 (encoded by cyoABCDE) is the terminal cytochrome oxidase in the respiratory chain. This indicates that the symbiont is capable of growth under high oxygen tension, similar to endosymbionts in the genera *Buchnera* and *Wigglesworthia* (Shigenobu et al., Nature 407: 81-86 (2000); Wernegreen, Nat Rev Genet 3: 850-861 (2002)). Conversely, intracellular pathogens from the genera *Legionella*, *Brucella*, *Chlamydia*, *Rickettsia*, or *Coxiella* are thought to rely on microaerophilic metabolism during intracellular growth (Omsland et al., Proc Natl Acad Sci USA 106: 4430-4434 (2009); Omsland et al., (2011) Annu Rev Microbiol 65: 111-128 (2009)).

Amino Acid and Cofactor Metabolism

Similar to most obligate endosymbionts and many intracellular pathogens, Ca. *E. frumentensis* seems to lack a number of genes involved in the biosynthesis of key amino acids and cofactors. The genome only has intact pathways for de novo biosynthesis of asparagine, aspartic acid, glutamine, and glutamic acid. Pathways for the remaining 16 amino acids are either partially or completely missing, as are at least part of the pathways for several co-factors, including coenzyme A. The symbiont likely obtains many of these missing amino acids and co-factors from the tunicate host. Indeed, the Ca. *E. frumentensis* genome contains 71 transporter genes (see below), including genes encoding specific transporters for methionine, tryptophan, and tyrosine along with an additional putative amino acid transporter (FIG. 10).

The symbiont could also import pathway intermediates to complete production of some amino acids possessing partial biosynthetic pathways (e.g., glycine, serine, alanine, proline, and arginine).

Ca. E. frumentensis also seems to lack many genes involved in coenzyme A (CoA) biosynthesis, as noted above. Genes encoding enzymes responsible for both β-alanine and pantotheine production are completely absent. However, later steps of the CoA pathway are intact, indicating that the symbiont is probably capable of CoA biosynthesis using host-derived pantotheine, β-alanine, or another CoA precursor. The inability to produce CoA de novo is relatively common in endosymbionts and bacterial pathogens (Spry et al., FEMS Microbiol Rev 32: 56-10 (2008)). The obligate endosymbiont Buchnera aphidcola, for example, works collaboratively with its aphid host to biosynthesize CoA (Shigenobu et al., Nature 407: 81-86 (2000)). Similarly, intracellular pathogens from the genera Mycoplasma, Rickettsia, and Chlamydia have incomplete pathways for the coenzyme and often need media supplements for host-cell-free growth or pathogenicity (Trager et al., PNAS 72: 1834-1837 (1975); Bovarnick et al., J Gen Physiol 38: 169-179 (1954); Tourtellotte et al., Journal of Bacteriology 88: 11-15 (1964)). Only a selection of these species have transporters suspected to facilitate CoA and precursor environmental uptake (Renesto et al., FEMS Microbiol Rev 29: 99-117 (2005)).

Membranes and Transport

Figure 1C:
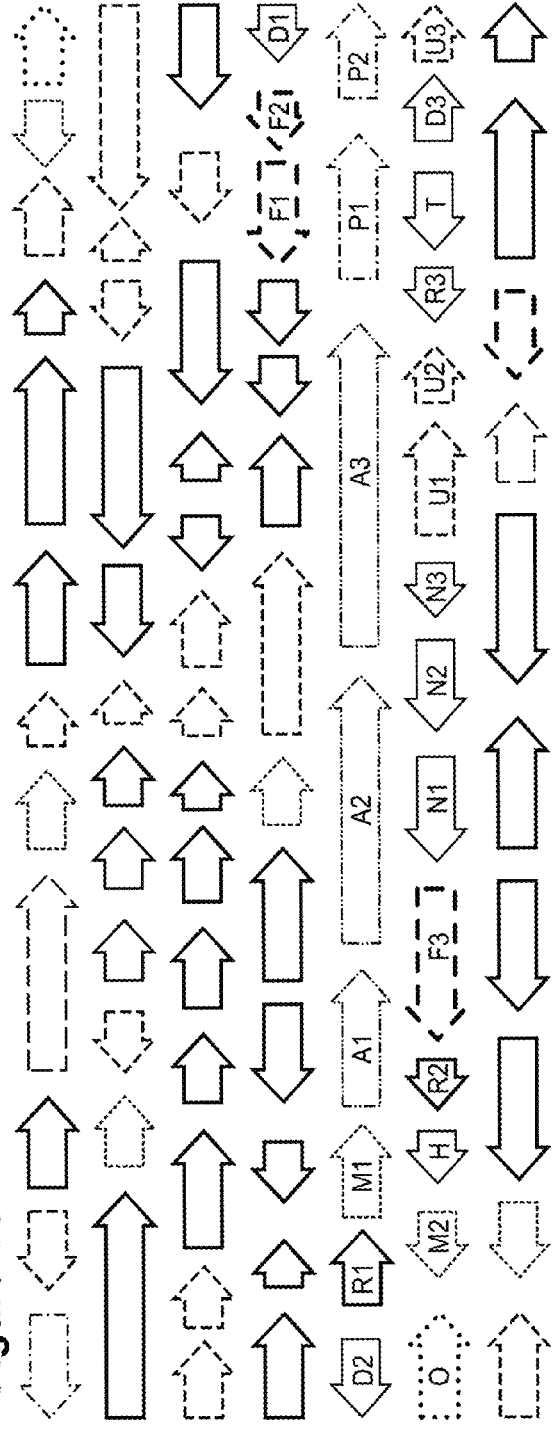

The Ca. E. frumentensis genome contains gene sets for the biosynthesis of lipids commonly incorporated into bacterial membranes, including phosphatidylethanolamine, cardiolipin, and phosphatidylglycerol (FIG. 1). However, the endosymbiont possesses an incomplete gene set for peptidoglycan biosynthesis (FIG. 1). The vast majority of bacteria incorporate some level of peptidoglycan into their cell walls, but peptidoglycan is absent in some bacteria, including Mycoplasma species, Planctomyces, Rickettsia, and Chlamidiae. Studies have also recently demonstrated that some endosymbionts may lack the ability to make peptidoglycan. Like Ca. E. frumentensis, the insect endosymbionts B. aphidicola BCc (Pérez-Brocal et al., Science 314: 312-313 (2006)), Carsonella ruddii (Nakabachi et al., Science 314: 267-267 (2006)), and Ca. Sulcia muelleri (Wu et al., PLoS Biol 4: e188 (2006)) are missing the majority of genes involved in the biosynthesis of peptidoglycan. Only dacA, the gene responsible for the final processing step in peptidoglycan biosynthesis, is present in the Ca. E. frumentensis genome (FIG. 1).

In addition to peptidoglycan, Ca. E. frumentensis also appears to lack the genes responsible for biosynthesizing and incorporating lipopolysaccharides in its outer membrane (FIG. 1). Lipid A biosynthetic genes are missing from Ca. E. frumentensis and are also absent from some other endosymbionts, including Baumannia cicadellinicola and Buchnera species (Moran et al., Annu Rev Genet 42: 165-190 (2008); Wu et al., PLoS Biol 4: e188 (2006)), although most Gram-negative bacteria possess lipid A-containing lipopolysaccharides in their outer membranes. The loss of lipid A incorporation in these endosymbionts could be an evolutionary result of high toxicity to most eukaryotic hosts.

Some microorganisms undergoing genome reduction have been known to lack both peptidoglycan and lipid A, although these compounds are usually recognized as standard components of intracellular metabolism (Perez-Brocal et al., 2006).

Despite its unusual membrane makeup, the endosymbiont is still adept at metabolite transport. The genome encodes 71 genes putatively linked to transporter function. Although the specificity of many of these transporters is difficult to assess, others seem to have a more defined target based on annotation using database comparisons. In addition to amino acid and sugar phosphate transporters, the genome also encodes membrane proteins that may target inorganic phosphate, iron, and potassium along with sodium-calcium and sodium-hydrogen antiporters.

The microorganism also possesses a near intact Sec protein translocation pathway and enzymes involved in the recognition of signal peptides. Only the nonessential components SecG and SecM appear to be absent. The ABC transporter responsible for localization of lipoproteins to the periplasmic surface of the outer membrane (LolCDE), as well as essential components involved in inserting β-barrel proteins into the outer membrane (BamADE), are also present.

Secondary Metabolism

A 35 kb contig containing many of the genes involved in the biosynthesis of the chemotherapeutic natural product ET-743 has been identified (Rath et al., ACS Chem. Biol. 6(11): 1244-1256 (2011); see also U.S. Pat. No. 8,815,562, which is incorporated by reference herein in its entirety). Expansion of this contig to a complete genome for the microorganism confirms the physical link between ET-743 production and Ca. E. frumentensis. Researchers have suspected that a bacterium may be responsible for production of the natural product due to its structural similarity to secondary metabolites isolated from cultivable bacteria (Velasco et al., (2005) Mol Microbiol 56: 144-154 (2005); Proksch et al., (2002) Appl Microbiol Biotechnol 59: 125-134 (2002)). The specific and persistent association of Ca. E. frumentensis with the host tunicate provided the first indirect evidence that this bacterial species may be responsible for production of the compound (Perez-Matos et al., Antonie Van Leeuwenhoek 92: 155-164 (2007)). Associating the biosynthetic gene cluster with the 16S rDNA for Ca. E. frumentensis through % G+C content and codon usage provided additional indirect evidence for the producing organism (Rath et al., ACS Chem. Biol. 6(11): 1244-1256 (2011)). The near-complete draft genome disclosed herein now directly links the biosynthetic gene cluster to the 16S rRNA gene for Ca. E. frumentensis, providing direct evidence that this microbe is the true producer of the chemotherapeutic natural product ET-743.

Figure 6A:
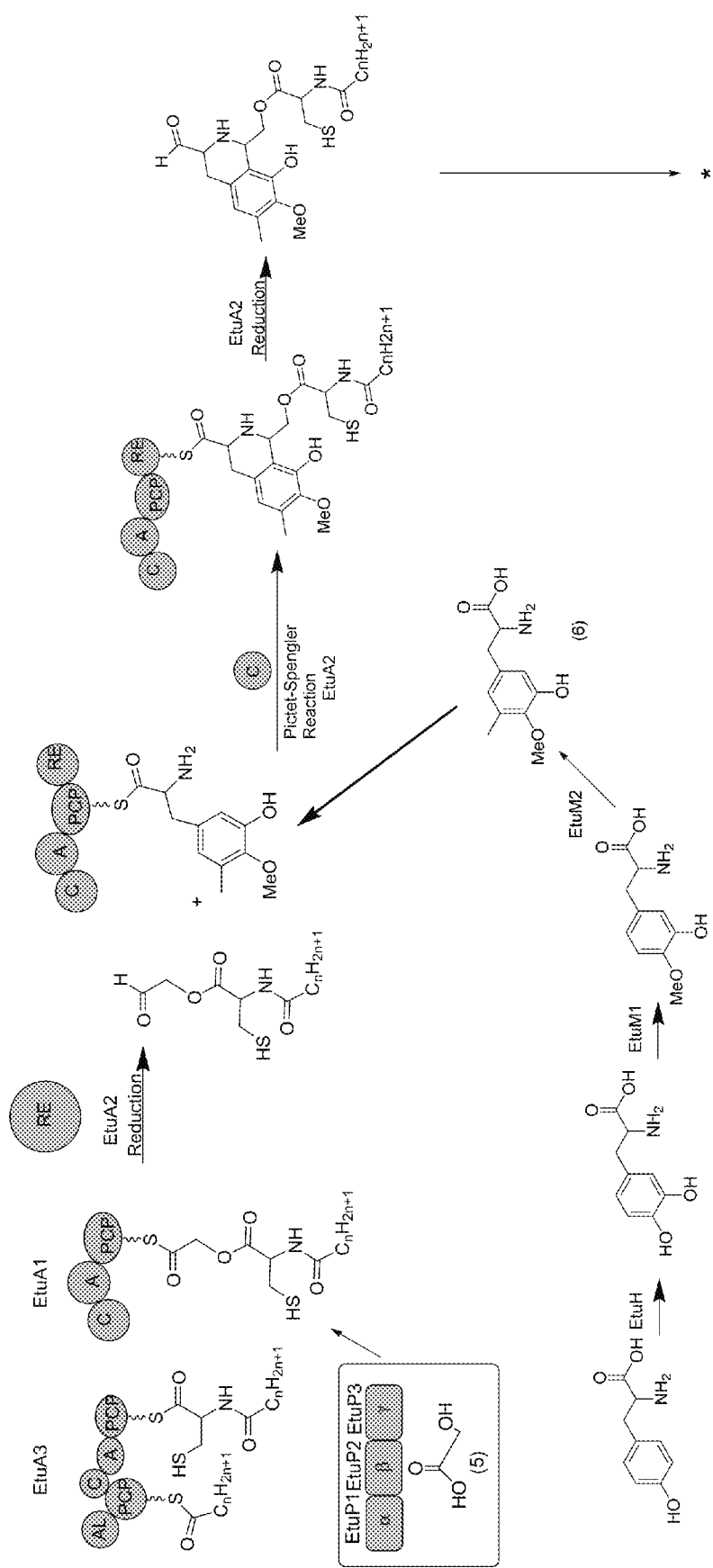
Figure 6B:
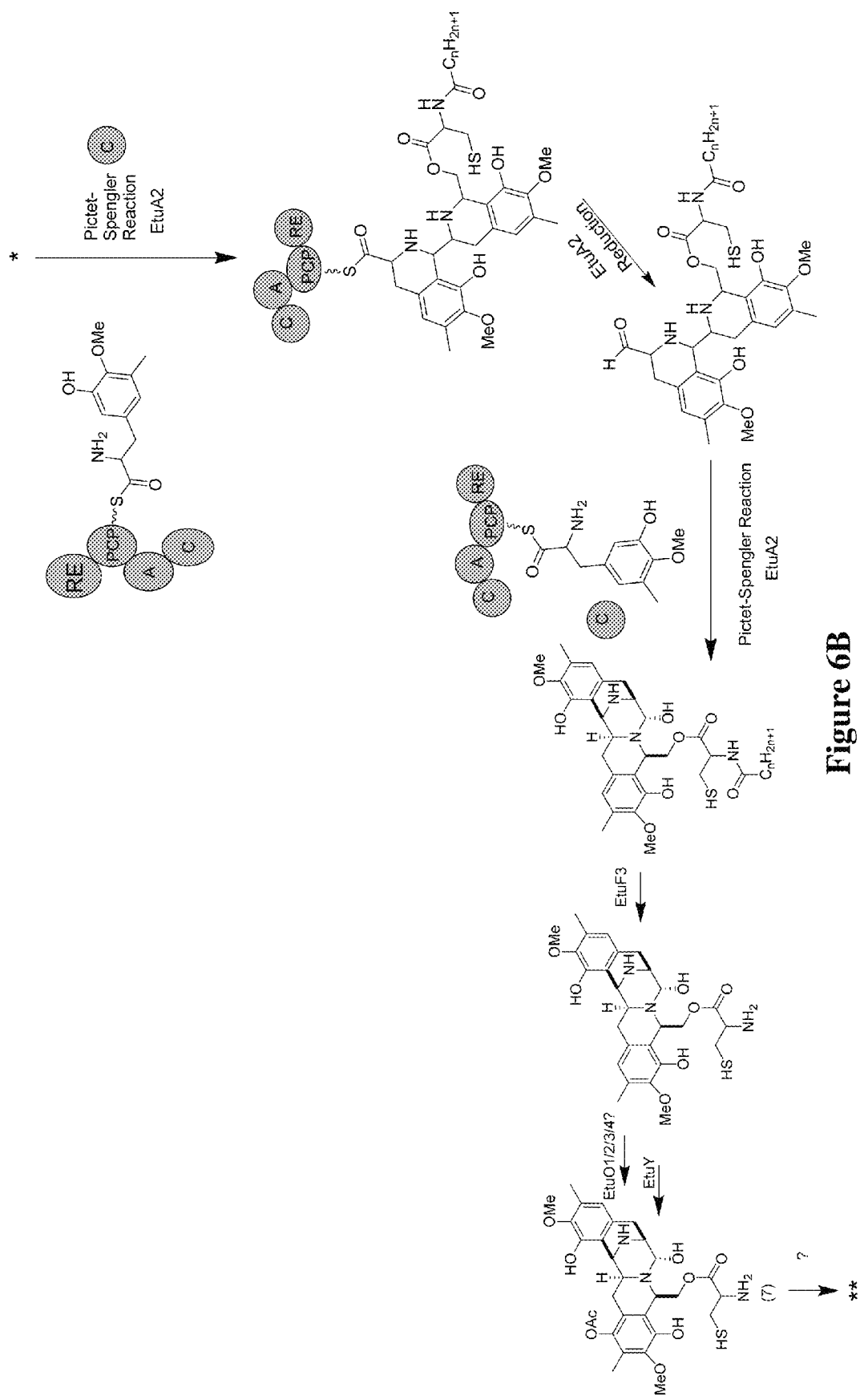
Figure 6C:
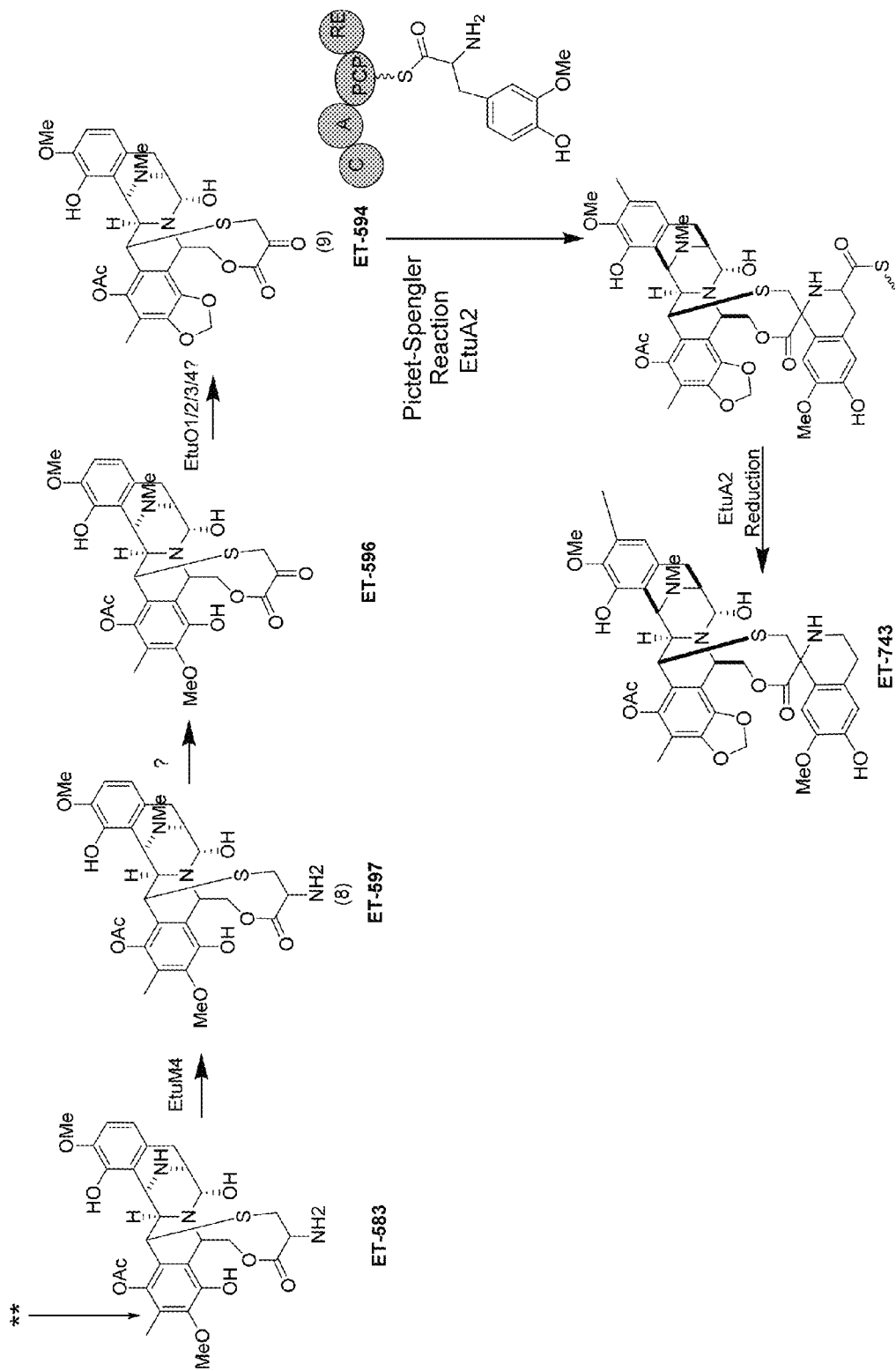
Figure 7A:
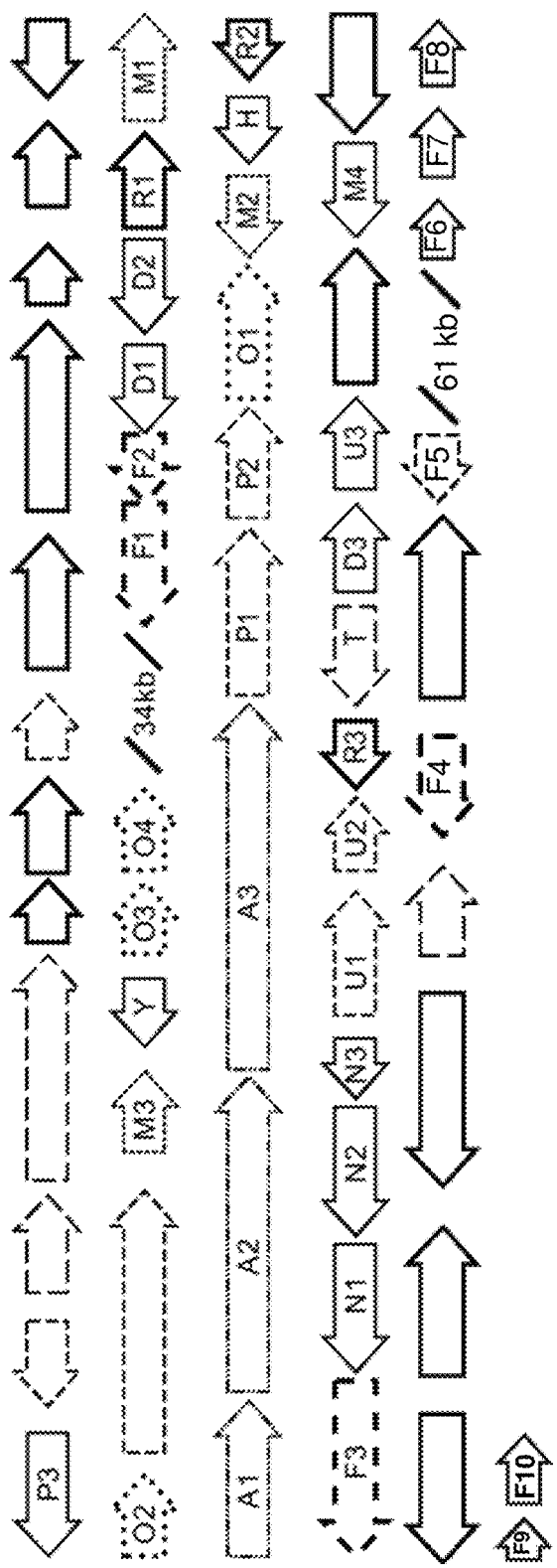
Figure 9:
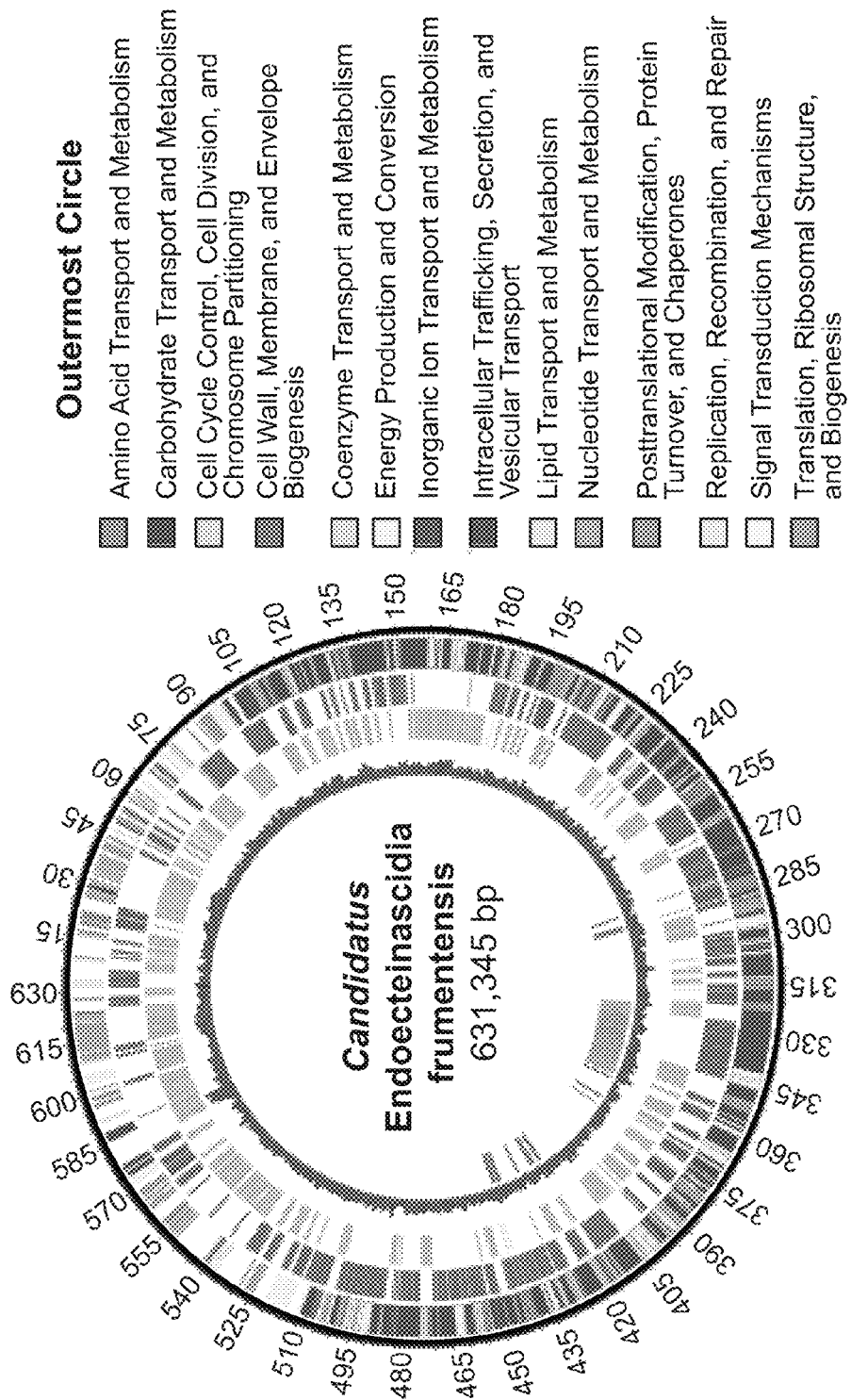

Analysis of the Ca. E. frumentensis genome has also improved the understanding of the importance of ET-743 biosynthesis in the relationship between the endosymbiont and the tunicate host, E. turbinata. Key genes involved in production of the chemotherapeutic drug are dispersed over 173 kb of the small 631 kb genome (FIG. 9). Biosynthetic genes are split into three distinct clusters within this expansive genomic range (FIG. 7A, Table 4). More recently detected gene products include the acetyltransferase EtuY and EtuM4, likely involved in acetylation and N-methylation to make compounds (7) and (9) (ET-597) of FIG. 7 (see also, FIG. 6), respectively. We also identified three new flavoproteins in addition to the FAD-dependent monooxygenase (EtuO1) contained within the original ET-743 biosynthetic gene cluster (Rath et al., 2011). In long-term co-diversification, bacterial genes that are useful to the host are retained despite ongoing genome erosion (McCutcheon et al., Nat Rev Microbiol 10: 13-26 (2012); Moran et al., Annu Rev Genet 42: 165-190 (2008)). The survival of ET-743 biosynthetic genes despite clear evidence of extreme genome reduction is indicative of an important role for the secondary metabolite to the host. A query of the gene cluster against the full complement of bioinformatics tools (e.g., antiSMASH 2.0 (Piel, Nat Prod Rep 26: 338-362 (2009)), SMURF (Staley et al., Annual Reviews in Microbiology 39: 321-346 (1985)), SBSPKS (Wilson et al., Chem Biol 20: 636-647 (2013)), NRPSpredictor (Lichter et al., Exp Biol Med (Maywood) 150: 475-478 (1975); Rinehart et al., J Org Chem 55(15): 4512-4515 (1990)), NP.searcher, and CLUSEAN (Pérez-Matos et al., Antonie Van Leeuwenhoek 92: 155-164 (2007)) revealed that ET-743 was the only natural product gene cluster found within the Ca. E. frumentensis genome, further exemplifying its ecological value to the tunicate. Adult ascidians such as E. turbinata are sessile marine invertebrates with soft bodies, making them particularly vulnerable to predation. Their large larvae are released during daylight hours, making them similarly susceptible to predators. Without being bound by theory, the secondary metabolite ET-743 could serve as a defense mechanism for the host. Many other ascidians and sponges are thought to produce secondary metabolites and inorganic acids that make them unpalatable to predators (Pisut et al., Journal of Experimental Marine Biology and Ecology 270: 203-214 (2002); Davis, Mar Biol 111: 375-379 (1991); Lindquist et al., Ecological Monographs 62: 547 (1992)). Indeed, studies have already demonstrated that taste and orange coloring of larvae from E. turbinata wards off predators (Pisut et al., Journal of Experimental Marine Biology and Ecology 270: 203-214 (2002); Young et al., Mar Biol 96: 539-54428 (1987)). If ET-743 is the chemical deterrent responsible for protecting the host, it explains the gene cluster's survival despite its host genome undergoing millions of years of genome reduction.

Although the previously identified gene cluster contains a high concentration of the ET-743 biosynthetic genes, a number of additional components have also been identified (FIG. 1; Table 4). This expanded gene cluster has provided gene candidates for missing steps in ET-743 biosynthesis and improved the understanding of how the microorganism produces the compound. For example, genes encoding products for acetylation (7) (see FIG. 6 for identification of compounds referenced parenthetically by number; see also, FIG. 7) or N-methylation of ET-583 to generate ET-597 (8) are elucidated. A gene encoding an acetyltransferase was found just 35 kb upstream of the original cluster alongside other biosynthetic genes (EtuY, FIG. 5). A gene encoding an N-methyltransferase (EtuM4, FIG. 5) was found immediately downstream of the original cluster along with additional genes expected to be involved in supplying substrate for synthesis of the fatty acid used by the NRPS EtuA3. Also included upstream of the cluster was a gene encoding the E3 component of pyruvate dehydrogenase (EtuP3), which is expected to work with EtuP1 and EtuP2 to supply glycolic acid substrate for use by the NRPS EtuA1 (Peng et al., Proc Natl Acad Sci USA 109: 8540-8545 (2012). Flavin enzymes that are contemplated to be involved in hydroxylation to make compound (7) or in the formation of the methylenedioxy bridge of compound (9) were also found upstream of the original cluster (FIG. 5, Table 4).

The reactions catalyzed by the pyruvate dehydrogenase (EtuP3) enzyme system typically provide the TCA cycle with acetyl-CoA (Patel et al., 2014). However, the primary metabolic enzymes were recently shown to also contribute to the biosynthesis of quinocarcin and naphtyridinomycin natural products (Peng et al., 2012). The enzyme complex can work with an acyl carrier protein (ACP) to provide a glycolicacyl-S-ACP extender unit (5) (see FIG. 7) for a non-ribosomal peptide synthetase (NRPS). Both of these gene clusters, in addition to SF-1739 (Hiratsuka et al., 2013) and the original ET-743 (Rath et al., 2011) biosynthetic gene clusters, contain the E1 and E2 components for the enzyme complex. Although the E3 component has been absent in previously studied clusters, purified exogenous E3 does seem necessary for complete product conversion (Peng et al., 2012). The presence of the E3 component in Ca. E. frumentensis and its proximity to other ET-743 biosynthetic genes further exemplifies its importance in the biosynthesis of tetrahydroisoquinoline natural products.

Figure 7B:
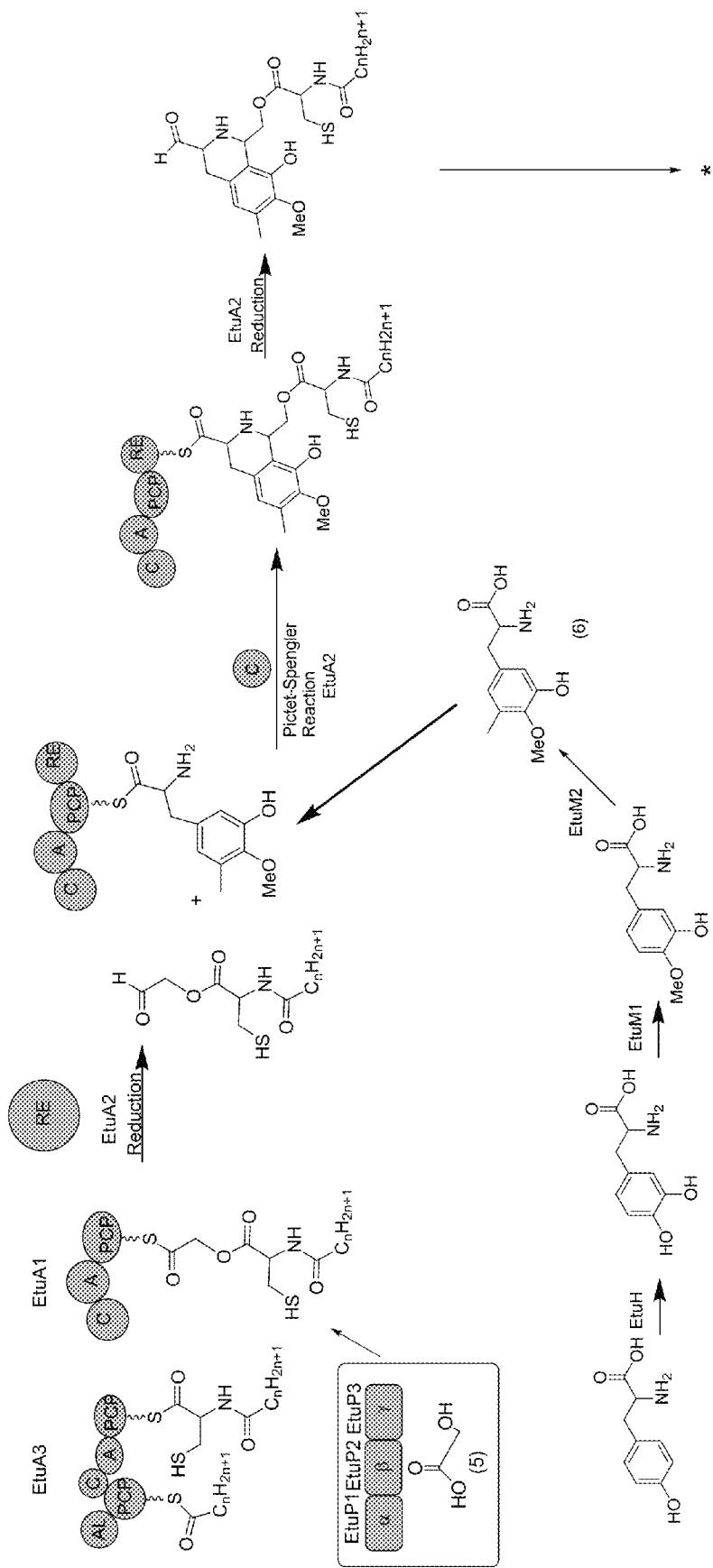
Figure 7C:
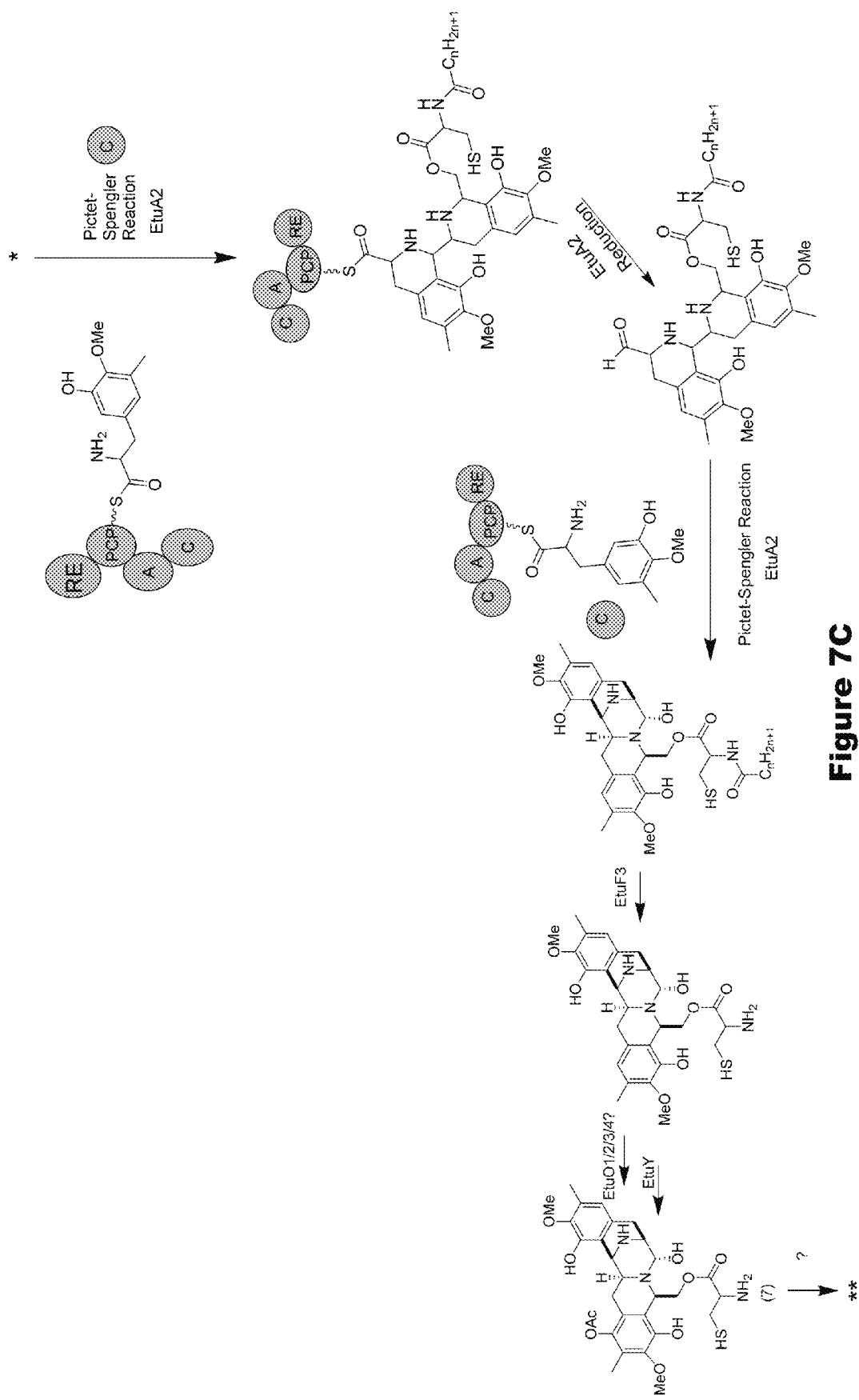
Figure 7D:
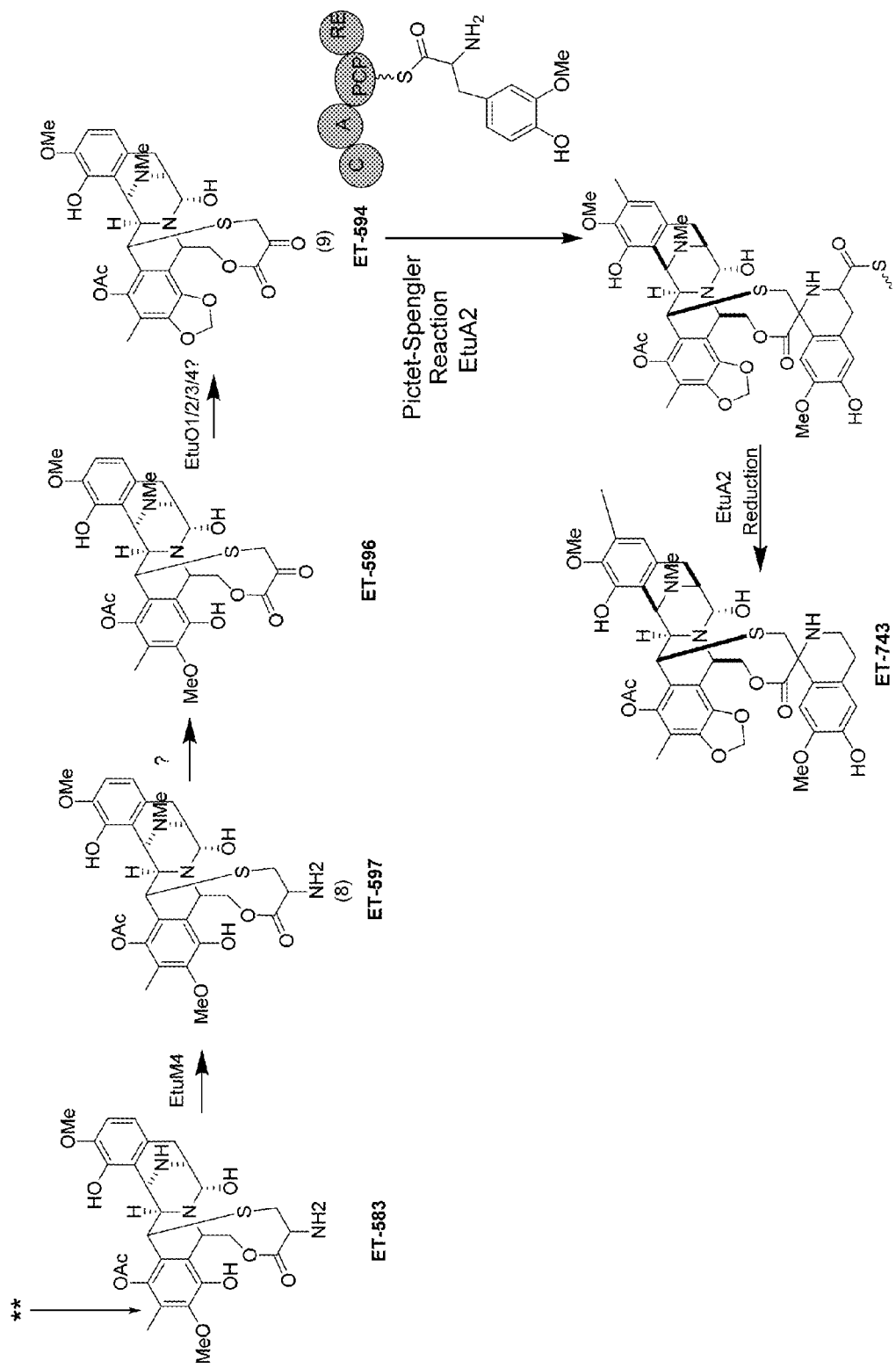
Figure 8C:
Figure 8C:
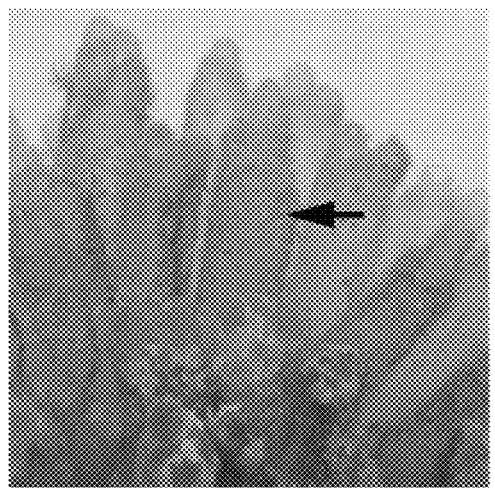
Figure 8C:
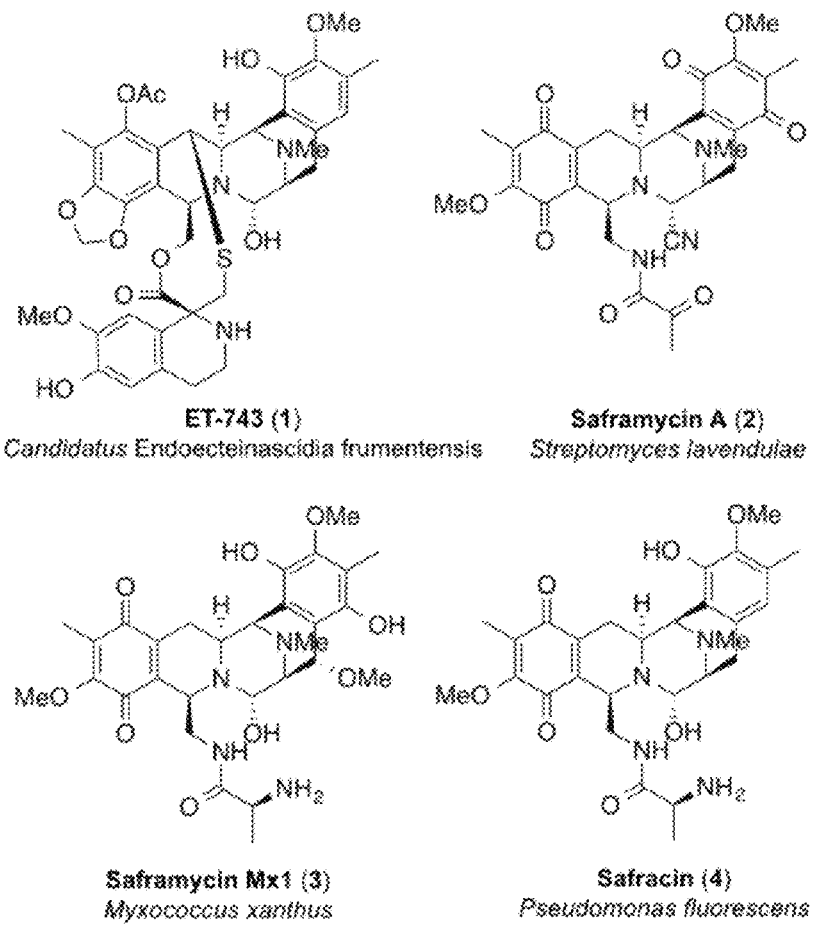

Another genomic feature expected to set the ET-743 cluster apart from other natural products is the placement of the gene encoding acyl carrier protein (ACP) that operates with the pyruvate dehydrogenase complex. The ACP is located in the main biosynthetic gene clusters for quinocarcin, naphtyridinomycin, and SF-1739. However, the only ACP in the entire Ca. E. frumentensis genome is located within a fatty acid biosynthetic cluster 61 kb downstream of the original ET-743 gene cluster (EtuF9, FIG. 7A). The location of the ACP and the presence of other fatty acid biosynthetic genes (EtuF1 and EtuF2) within the central ET-743 biosynthetic gene cluster further supports potential interaction between primary and secondary metabolism during ET-743 biosynthesis. This ACP is expected to work in concert with EtuP1, EtuP2, and EtuP3 to provide the glycolicacyl-S-ACP extender unit (5) to EtuA1 (FIG. 7B).

Outside of the expanded cluster, the genome contains additional genes that are typically included in the clusters of other tetrahydroisoquinoline natural products. For example, the exonuclease found in the quinocarcin, saframycin A, and SF-1739 gene clusters is located a few hundred basepairs upstream from the original ET-743 gene cluster. The gene encoding the excision nuclease subunit UvrA is found within the saframycin A, and SF-1739, and quinocarcin gene clusters, perhaps playing a role in repairing damage induced by these potent natural products. However, the gene in the Ca. E. frumentensis genome is located several hundred base pairs upstream from the original ET-743 gene cluster. The saframycin A gene cluster also contains a complete gene set for the recycling of S-adenosyl methionine (SAM), a coenzyme essential for methyltransferase activity during the biosynthesis of all tetrahydroisoquinoline natural products. The complete gene set for the recycling system is still present in the Ca. E. frumentensis genome, but the genes are located both upstream and downstream of the original 35 kb gene cluster. More particularly, genes for the SAM recycling system found in the saframycin A gene cluster are also variously localized 100 bp upstream and downstream of the original ET-743 cluster.

Microbial secondary metabolite biosynthetic genes are typically tightly clustered in bacteria with clearly identifiable boundaries (Walton, (2000) Fungal Genet Biol 30: 167-171 (2000); Chu et al., Plant J 66: 66-79 (2011)). Analysis of the Ca. E. frumentensis genome has revealed that the ET-743 biosynthetic gene cluster is semi-dispersed with the bulk of the genes clustered within a 35 kb continuous fragment, and additional secondary metabolite genes scattered as far as 100 kb upstream. Furthermore, numerous genes involved in primary metabolism are dispersed throughout the cluster (FIGS. 1 and 7). This fragmented gene cluster could be a consequence of horizontal gene transfer (Lawrence et al., Genetics 143: 1843-1860 (1996)) and co-regulation of gene expression within operons (Price et al., Genome Res 15: 809-819 (2005)), which are two important forces thought to encourage selection and formation of gene clusters. However, the endosymbiont lifestyle provides few opportunities for horizontal gene transfer and regulation mechanisms are often among the first genetic elements lost during genome reduction (McCutcheon et al., Nat Rev Microbiol 10: 13-26 (2012); Moran et al., Annu Rev Genet 42: 165-190 (2008)). The lack of selective pressure to retain clusters is thought to contribute to fragmentation of biosynthetic genes in other endosymbionts (Kwan et al., Proc Natl Acad Sci USA 109: 20655-20660 (2012)), and likely also plays a role in the organization of genes involved in ET-743 production.

Analysis of the Ca. *E. frumentensis* genome has also improved our understanding of the importance of ET-743 biosynthesis in the relationship between the endosymbiont and the tunicate host, *E. turbinata*. In long-term co-evolution, bacterial genes that are useful to the host are retained despite ongoing genome erosion (Moran et al., 2008; McCutcheon and Moran, 2012). The survival of ET-743 biosynthetic genes, despite clear evidence of extreme genome reduction, is indicative of an important role for the secondary metabolite to the host. A query of the endosymbiont genome against the full complement of bioinformatics tools revealed that ET-743 was the only natural product gene

TABLE 4

Genome coordinates are relative to the 631,345 by DNA sequence disclosed in Appendix A. The parenthetical numbers in column 3 ("Putative Role") correspond to the parenthetical numbers shown in FIG. 6.

| Gene Product | Function | Role | Genome Coordinates (bp) | |
|---|---|---|---|---|
| | | | Start | End |
| EtuP3 | Pyruvate dehydrogenase-E3 Component (SEQ ID NO: 421) | Assists EtuP1 and P2 in supplying glycolic acid (5) for NRPS enzymes | 266,073 | 267,440 |
| EtuO2 | Flavodoxin reductase (ferredoxin NADPH reductase) (SEQ ID NO: 420) | Expected hydroxylation (7) or methylenedioxy bridge (9) formation | 280,797 | 281,537 |
| EtuM3 | O-Methyltransferase (SEQ ID NO: 288) | EtuA2 substrate formation (6) or later methylation | 285,669 | 286,331 |
| EtuY | Carbonic anhydrase/acetyltransferase (SEQ ID NO: 289) | Acetylation to make (7) | 286,333 | 286,884 |
| EtuO3 | Flavoprotein (SEQ ID NO: 290) | Possible hydroxylation (7) or methylenedioxy bridge (9) formation or CoA biosynthesis | 286,966 | 287,511 |
| EtuO4 | Flavoprotein (SEQ ID NO: 291) | Possible hydroxylation (7) or methylenedioxy bridge (9) formation or CoA biosynthesis | 287,508 | 288,164 |
| EtuM4 | N-Methyltransferase (SEQ ID NO: 350) | N-methylation to make (8) | 360,210 | 361,064 |
| EtuF4 | birA, biotin-[acetyl-CoA-carboxylase] ligase region (SEQ ID NO: 423) | Fatty acid biosynthesis and/or substrate formation for the NRPS enzyme EtuA3 | 370,417 | 371,433 |
| EtuF5 | 3-hydroxyacyl-[acyl-carrier-protein] dehydratase (SEQ ID NO: 425) | Fatty acid biosynthesis and/or substrate formation for the NRPS enzyme EtuA3 | 374,717 | 375,166 |
| EuF6 | phosphate:acyl-[acyl carrier protein] acyltransferase (SEQ ID NO: 427) | Fatty acid biosynthesis and/or substrate formation for the NRPS enzyme EtuA3 | 435,106 | 436,137 |
| EtuF7 | malonyl CoA-acyl carrier protein transacylase (SEQ ID NO: 429) | Fatty acid biosynthesis and/or substrate formation for the NRPS enzyme EtuA3 | 436,188 | 437,078 |
| EtuF8 | 3-oxoacyl-[acyl-carrier-protein] reductase (SEQ ID NO: 431) | Fatty acid biosynthesis and/or substrate formation for the NRPS enzyme EtuA3 | 437,153 | 437,905 |
| EtuF9 | acyl carrier protein (SEQ ID NO: 433) | Possible loading of glycolic acid for the NRPS enzyme EtuA1 | 437,952 | 438,188 |
| EtuF10 | β-ketoacyl-acyl-carrier-protein synthase II (SEQ ID NO: 435) | Fatty acid biosynthesis and/or substrate formation for the NRPS enzyme EtuA3 | 438,293 | 439,534 | cluster found within the genome, further exemplifying its ecological value to the tunicate. Adult ascidians such as *E. turbinata* are sessile marine invertebrates with soft bodies, making them particularly vulnerable to predation. Their large larvae are released during daylight hours, making them similarly susceptible to predators. The secondary metabolite ET-743 could serve as a defense mechanism for the host. Many other ascidians and sponges are thought to produce secondary metabolites and inorganic acids that make them unpalatable (Lindquist et al., 1992). Indeed, ecological studies have already demonstrated that taste and orange coloring of larvae from *E. turbinata* protects the animal against predators (Young and Bingham, 1987). If ET-743 is the chemical deterrent responsible for protecting the host, it provides a driving force to assure ET-743 gene cluster survival despite millions of years of genome reduction.

CONCLUSION

Disclosed herein is the complete genome for Ca. *E. frumentensis*, an endosymbiont responsible for production of the chemotherapeutic drug ET-743. Microbial symbionts have long been thought to be the source of many natural products isolated from terrestrial and marine invertebrates. However, very little is known about the majority of these microbes due to our current inability to culture them in the laboratory. The endosymbiont genome presented here shows evidence of extreme genome reduction and specialization for ET-743 biosynthesis.

The drastically reduced genome is consistent with the microorganism being unable to live independently of the host using standard media and cultivation techniques. The loss of genes involved in amino acid, coenzyme A, and glucose biosynthesis indicates that media enhanced with nutrients, cofactors, and alternative carbon sources is necessary. This explains previous failed attempts to grow the microorganism in the laboratory for production of the chemotherapeutic drug (Moss et al., Mar Biol. 143: 99-110 (2003)). However, the ability to culture elusive microorganisms is continually improving. The disclosure provides an essential basis and insight into facilitating access to the drug as well as analogs thereof.

Analysis of the complete genome has highlighted the importance of ET-743 to the host-symbiont relationship. The lack of genomic evidence for other secondary metabolites, the survival of the gene cluster despite extreme genome reduction, and the cluster's dispersal across the small genome indicates that the microbe has become specialized for production of the drug. The chemotherapeutic natural product is therefore important to the microorganism's relationship with the tunicate host and its continued survival. This is intriguing because secondary metabolites are traditionally thought to be nonessential for microbial life (Williams et al., 1989) despite their prevalence in microbial genomes and ability to confer competitive advantages (Stone and Williams, 1992). Improved sequencing technologies and metagenomic pipelines, however, now permit more detailed studies of genomes undergoing reduction. Full genome studies on the endosymbionts found in macroorganisms like insects (Nakabachi et al., 2013), tunicates (Kwan et al., 2012; Kwan and Schmidt, 2013), or even fungi (Lackner et al., 2011) provide increasing evidence that natural products may sometimes play essential roles. When these secondary metabolites benefit a host organism, their preservation may ensure a microorganism's survival and even facilitate co-evolution with a host. The drastically reduced genome of Ca. *E. frumentensis* presented here further supports this position.

A better understanding of symbiont genomes along with their primary and secondary metabolisms is expected to provide new routes to economical and sustainable large-scale production of bioactive natural products. Analysis of the drastically reduced genome of Ca. *E. frumentensis* provides unique insight into the microorganism's lifestyle and is useful in efforts to develop host-free cultivation. Previous attempts to grow the microorganism in the laboratory were unsuccessful. The ability to culture elusive microorganisms is continually improving, however. Recent advances in host cell-free growth of *Coxiella burnetii* (Omsland et al., 2009) or the facultative symbionts *Burkholderia* spp., *Rhodococcus rhodnii*, and *Wolbachia* spp. (Kikuchi, 2009) motivates efforts to develop suitable growing conditions and techniques to access the uncultivable majority of bacteria. Genome analysis in particular has proven a powerful method to pinpoint nutrient and oxygen requirements for microbial growth (Omsland et al., 2009; Kikuchi, 2009). The loss of key primary metabolic pathways in Ca. *E. frumentensis* indicates that the microorganism could not live independently of the host using standard media and cultivation techniques. The loss of genes involved in amino acid, coenzyme A, and glucose biosynthesis indicates that media enhanced with nutrients, cofactors, and alternative carbon sources could be required. Genomic evidence for aerobic respiration and transporters for key metabolites, however, indicates that the right environmental conditions might lead to host cell-free growth.

REFERENCES

Bachmann, B. O. and Ravel, J. (2009) Methods for In Silico Prediction of Microbial Polyketide and Nonribosomal Peptide Biosynthetic Pathways from DNA Sequence Data. Methods Enzymol 458: 181-217.

Blin, K., Medema, M. H., Kazempour, D., Fischbach, M. A., Breitling, R., Takano, E., and Weber, T. (2013) antiSMASH 2.0—a versatile platform for genome mining of secondary metabolite producers. Nucleic Acids Res 41: W204-12.

Carballo, J. L., Naranjo, S., Kukurtzii, B., Calle, F., and Hernandez Zanuy, A. (2000) Production of *Ecteinascidia turbinata* (Ascidiacea: Perophoridae) for Obtaining Anticancer Compounds. J World Aquac Soc 31: 481-490.

Chu, H. Y., Wegel, E., and Osbourn, A. (2011) From hormones to secondary metabolism: the emergence of metabolic gene clusters in plants. Plant J 66: 66-79.

Ciccarelli, F. D. (2006) Toward Automatic Reconstruction of a Highly Resolved Tree of Life. Science 311: 1283-1287.

Corey, E. J., Gin, D. Y., and Kania, R. S. (1996) Enantioselective total synthesis of ecteinascidin 743. J Am Chem Soc 118: 9202-9203.

Cuevas, C. and Francesch, A. (2009) Development of Yondelis (trabectedin, ET-743). A semisynthetic process solves the supply problem. Nat Prod Rep 26: 322-337.

Dick, G. J., Andersson, A. F., Baker, B. J., Simmons, S. L., Thomas, B. C., Yelton, A. P., and Banfield, J. F. (2009) Community-wide analysis of microbial genome sequence signatures. Genome Biol 10: R85.

Hiratsuka, T., Koketsu, K., Minami, A., Kaneko, S., Yamazaki, C., Watanabe, K., et al. (2013) Core assembly mechanism of quinocarcin/SF-1739: bimodular complex nonribosomal peptide synthetases for sequential mannich-type reactions. Chem Biol 20: 1523-1535.

Kikuchi, Y. (2009) Endosymbiotic bacteria in insects: their diversity and culturability. Microbes Environ 24: 195-204.

Konstantinidis, K. T. and Tiedje, J. M. (2005) Towards a genome-based taxonomy for prokaryotes. J Bacteriol 187: 6258-6264.

Krzywinski, M., Schein, J., Birol, I., Connors, J., Gascoyne, R., Horsman, D., et al. (2009) Circos: an information aesthetic for comparative genomics. Genome Res 19: 1639-1645.

Kuo, C.-H. and Ochman, H. (2009) Deletional bias across the three domains of life. Genome Biol Evol 1: 145-152.

Kuo, C.-H., Moran, N. A., and Ochman, H. (2009) The consequences of genetic drift for bacterial genome complexity. Genome Res 19: 1450-1454.

Kwan, J. C. and Schmidt, E. W. (2013) Bacterial endosymbiosis in a chordate host: long-term co-evolution and conservation of secondary metabolism. PLoS ONE 8: e80822.

Kwan, J. C., Donia, M. S., Han, A. W., Hirose, E., Haygood, M. G., and Schmidt, E. W. (2012) Genome streamlining and chemical defense in a coral reef symbiosis. Proc Natl Acad Sci USA 109: 20655-20660.

Kwan, J. C., Tianero, M. D. B., Donia, M. S., Wyche, T. P., Bugni, T. S., and Schmidt, E. W. (2014) Host control of symbiont natural product chemistry in cryptic populations of the tunicate Lissoclinum patella. PLoS ONE 9: e95850.

Lackner, G., Moebius, N., Partida-Martinez, L. P., Boland, S., and Hertweck, C. (2011) Evolution of an endofungal lifestyle: Deductions from the Burkholderia rhizoxinica genome. BMC Genomics 12: 210.

Lawrence, J. G. and Roth, J. R. (1996) Selfish operons: horizontal transfer may drive the evolution of gene clusters. Genetics 143: 1843-1860.

Lei, L., Deng, W., Song, J., Ding, W., Zhao, Q.-F., Peng, C., et al. (2008) Characterization of the saframycin A gene cluster from Streptomyces lavendulae NRRL 11002 revealing a nonribosomal peptide synthetase system for assembling the unusual tetrapeptidyl skeleton in an iterative manner. J Bacteriol 190: 251-263.

Li, M. H., Ung, P. M. U., Zajkowski, J., Garneau-Tsodikova, S., and Sherman, D. H. (2009) Automated genome mining for natural products. BMC Bioinformatics 10: 185.

Lichter, W., Lopez, D. M., Wellham, L., and Sigel, M. M. (1975) Ecteinascidia turbinata extracts inhibit DNA synthesis in lymphocytes after mitogenic stimulation by lectins. Exp Biol Med 150.

Lindquist, N., Hay, M. E., and Fenical, W. (1992) Defense of ascidians and their conspicuous larvae: adult vs. larval chemical defenses. Ecol Monogr 62: 547.

Markowitz, V. M., Chen, I.-M. A., Palaniappan, K., Chu, K., Szeto, E., Pillay, M., et al. (2014) IMG 4 version of the integrated microbial genomes comparative analysis system. Nucleic Acids Res 42: D560-7.

Markowitz, V. M., Chen, I. M. A., Chu, K., Szeto, E., Palaniappan, K., Pillay, M., et al. (2013) IMG/M 4 version of the integrated metagenome comparative analysis system. Nucleic Acids Res 42: D568-D573.

McCutcheon, J. P. and Moran, N. A. (2012) Extreme genome reduction in symbiotic bacteria. Nat Rev Microbiol 10: 13-26.

McLaughlin, K. (2015) U. S. FDA Grants Priority Review for YONDELIS® (trabectedin) for the Treatment of Patients with Advan.

Moran, N. A. (1996) Accelerated evolution and Muller's rachet in endosymbiotic bacteria. Proc Natl Acad Sci USA 93: 2873-2878.

Moran, N. A. and Munson, M. A. (1993) A molecular clock in endosymbiotic bacteria is calibrated using the insect hosts. Proc R Soc Lond B 253: 167-171.

Moran, N. A., McCutcheon, J. P., and Nakabachi, A. (2008) Genomics and evolution of heritable bacterial symbionts. Annu Rev Genet 42: 165-190.

Moss, C., Green, D. H., Pérez, B., Velasco, A., and Henríquez, R. (2003) Intracellular bacteria associated with the ascidian Ecteinascidia turbinata: phylogenetic and in situ hybridisation analysis. Mar Biol 143: 99-110.

Munoz-Elias, E. J. and McKinney, J. D. (2006) Carbon metabolism of intracellular bacteria. Cell Microbiol 8: 10-22.

Nakabachi, A., Ueoka, R., Oshima, K., Teta, R., Mangoni, A., Gurgui, M., et al. (2013) Defensive bacteriome symbiont with a drastically reduced genome. Curr Biol 23: 1478-1484.

Newman, D. J. and Cragg, G. M. (2012) Natural products as sources of new drugs over the 30 years from 1981 to 2010. J Nat Prod 75: 311-335.

Omsland, A., Cockrell, D. C., Howe, D., Fischer, E. R., Virtaneva, K., Sturdevant, D. E., et al. (2009) Host cell-free growth of the Q fever bacterium Coxiella burnetii. Proc Natl Acad Sci USA 106: 4430-4434.

Patel, M. S., Nemeria, N. S., Furey, W., and Jordan, F. (2014) The pyruvate dehydrogenase complexes: structure-based function and regulation. J Biol Chem 289: 16615-16623.

Peng, C., Pu, J.-Y., Song, L.-Q., Jian, X.-H., Tang, M.-C., and Tang, G.-L. (2012) Hijacking a hydroxyethyl unit from a central metabolic ketose into a nonribosomal peptide assembly line. Proc Natl Acad Sci USA 109: 8540-8545.

Pérez-Brocal, V., Gil, R., Ramos, S., Lamelas, A., Postigo, M., Michelena, J. M., et al. (2006) A small microbial genome: the end of a long symbiotic relationship? Science 314: 312-313.

Pérez-Matos, A. E., Rosado, W., and Govind, N. S. (2007) Bacterial diversity associated with the Caribbean tunicate Ecteinascidia turbinata. Antonie Van Leeuwenhoek 92: 155-164.

Piel, J. (2009) Metabolites from symbiotic bacteria. Nat Prod Rep 26: 338-362.

Pospiech, A., Cluzel, B., Bietenhader, J., and Schupp, T. (1995) A new Myxococcus xanthus gene cluster for the biosynthesis of the antibiotic saframycin Mx1 encoding a peptide synthetase. Microbiology 141: 1793-1803.

Price, M. N., Huang, K. H., Arkin, A. P., and Alm, E. J. (2005) Operon formation is driven by co-regulation and not by horizontal gene transfer. Genome Res 15: 809-819.

Rath, C. M., Janto, B., Earl, J., Ahmed, A., Hu, F. Z., Hiller, L., et al. (2011) Meta-omic characterization of the marine invertebrate microbial consortium that produces the chemotherapeutic natural product ET-743. ACS Chem Biol 6: 1244-1256.

Rinehart, K. L., Holt, T. G., and Fregeau, N. L. (1990) Ecteinascidins 729, 743, 745, 759A, 759B, and 770: potent antitumor agents from the Caribbean tunicate Ecteinascidia turbinata. J Org Chem 55: 4512-4515.

Shigenobu, S., Watanabe, H., Hattori, M., Sakaki, Y., and Ishikawa, H. (2000) Genome sequence of the endocellular bacterial symbiont of aphids Buchnera sp. APS. Nature 407: 81-86.

Staley, J. T. and Konopka, A. (1985) Measurement of in situ activities of nonphotosynthetic microorganisms in aquatic and terrestrial habitats. Annu Rev Microbiol 39: 321-346.

Stone, M. J. and Williams, D. H. (1992) On the evolution of functional secondary metabolites (natural products). Mol Microbiol 6: 29-34.

van Heel, A. J., de Jong, A., Montalban-Lopez, M., Kok, J., and Kuipers, O. P. (2013) BAGEL3: automated identification of genes encoding bacteriocins and (non-)bactericidal posttranslationally modified peptides. Nucleic Acids Res 41: W448-53.

Velasco, A., Acebo, P., Gomez, A., Schleissner, C., Rodriguez, P., Aparicio, T., et al. (2005) Molecular characterization of the safracin biosynthetic pathway from *Pseudomonas fluorescens* A2-2: designing new cytotoxic compounds. Mol Microbiol 56: 144-154. Walton, J. D. (2000) Horizontal gene transfer and the evolution of secondary metabolite gene clusters in fungi: an hypothesis. Fungal Genet Biol 30: 167-171.

Weber, T., Rausch, C., Lopez, P., Hoof, I., and Gaykova, V. (2009) CLUSEAN: a computer-based framework for the automated analysis of bacterial secondary metabolite biosynthetic gene clusters. J Biotechnol 140: 13-17.

Wernegreen, J. J. (2002) Genome evolution in bacterial endosymbionts of insects. Nat Rev Genet 3: 850-861.

Williams, D. H., Stone, M. J., Hauck, P. R., and Rahman, S. K. (1989) Why are secondary metabolites (natural-products) biosynthesized? J Nat Prod 52: 1189-1208.

Wu, D., Daugherty, S. C., Van Aken, S. E., Pai, G. H., Watkins, K. L., Khouri, H., et al. (2006) Metabolic complementarity and genomics of the dual bacterial symbiosis of sharpshooters. PLoS Biol 4: e188.

Yarza, P., Yilmaz, P., Pruesse, E., Glockner, F. O., Ludwig, W., Schleifer, K.-H., et al. (2014) Uniting the classification of cultured and uncultured bacteria and archaea using 16S rRNA gene sequences. Nat Rev Microbiol 12: 635-645.

Young, C. M. and Bingham, B. L. (1987) Chemical defense and aposematic coloration in larvae of the ascidian *Ecteinascidia turbinata*. Mar Biol 96: 539-544.

Each of the references cited herein is hereby incorporated by reference in its entirety or in relevant part, as would be apparent from the context of the citation.

While the present invention has been described in terms of various embodiments and examples, it is understood that variations and improvements will occur to those skilled in the art. Therefore, only such limitations as appear in the claims should be placed on the invention.

SEQUENCE LISTING (435 sequences)

SEQ ID NO: 1 - DNA, 427885 bp, Candidatus Endoecteinascidia frumentensis
  misc_feature (197)..(1209): Hydroxymethylglutaryl-coenzyme A reductase
  misc_feature (1219)..(1712): Hydroxymethylglutaryl-coenzyme A synthase N
  misc_feature (1360)..(1673): Chalcone and stilbene synthases, N-terminal
  misc_feature (1738)..(1955): Hydroxymethylglutaryl-coenzyme A synthase C
  misc_feature (1999)..(2255): Hydroxymethylglutaryl-coenzyme A synthase C
  misc_feature (2742)..(2947): GHMP kinases N terminal domain
  misc_feature (3690)..(3895): GHMP kinases N terminal domain
  misc_feature (4137)..(4297): GHMP kinases C terminal
  misc_feature (4711)..(4856): GHMP kinases N terminal domain
  misc_feature (5546)..(5823): Rhodanese-like domain
  misc_feature (5941)..(6364): Colicin V production protein
  misc_feature (6676)..(6895): Mur ligase family, glutamate ligase domain
  misc_feature (7186)..(7618): Mur ligase middle domain
  misc_feature (7883)..(8309): Carboxyl transferase domain
  misc_feature (8447)..(8540): RNA polymerases M/15 Kd subunit
  misc_feature (8676)..(8976): RNA polymerases M/15 Kd subunit
  misc_feature (9102)..(9393): tRNA pseudouridine synthase
  misc_feature (9632)..(10023): Flavoprotein
  misc_feature (10344)..(10572): 4'-phosphopantetheinyl transferase superfamily
  misc_feature (10991)..(11210): Flavinator of succinate dehydrogenase
  misc_feature (11320)..(11576): Aminomethyltransferase folate-binding domain
  misc_feature (11851)..(12056): Glycine cleavage T-protein C-terminal barrel domain
  misc_feature (12403)..(12628): Hexamethylene bis-acetamide-inducible protein
  misc_feature (13076)..(13577): RecF/RecN/SMC N terminal domain
  misc_feature (13079)..(13571): AAA domain
  misc_feature (13091)..(13325): AAA ATPase domain
  misc_feature (13109)..(13289): Putative exonuclease SbcCD, C subunit
  misc_feature (13154)..(13598): ABC transporter
  misc_feature (13514)..(13577): AAA domain
  misc_feature (13517)..(13586): P-loop containing region of AAA domain
  misc_feature (13666)..(14611): FecCD transport family
  misc_feature (14988)..(15298): Septum formation inhibitor MinC, N-terminal domain
  misc_feature (15348)..(15661): Septum formation inhibitor MinC, C-terminal domain
  misc_feature (15846)..(16035): DALR domain
  misc_feature (16116)..(17013): tRNA synthetases class I (C) catalytic domain
  misc_feature (16119)..(16278): tRNA synthetases class I (K)
  misc_feature (16131)..(16314): tRNA synthetases class I (M)
  misc_feature (16143)..(16290): tRNA synthetases class I (I, L, M and V)
  misc_feature (16749)..(16959): tRNA synthetases class I (M)
  misc_feature (17240)..(17357): Trm112p-like protein
  misc_feature (17522)..(17936): Methyltransferase domain
  misc_feature (17546)..(17930): Methyltransferase domain
  misc_feature (17549)..(17951): Methyltransferase small domain
  misc_feature (17591)..(17954): O-methyltransferase
  misc_feature (17678)..(17930): Methyltransferase domain
  misc_feature (17678)..(17930): Methyltransferase domain
  misc_feature (17678)..(17948): Met-10+ like-protein
  misc_feature (17678)..(17993): Conserved hypothetical protein 95
  misc_feature (17690)..(17945): Protein of unknown function (DUF890)
  misc_feature (17699)..(17948): Putative RNA methylase family UPF0020
  misc_feature (17702)..(17936): RNA cap guanine-N2 methyltransferase
  misc_feature (17711)..(17927): Methyltransferase domain
  misc_feature (17711)..(17927): Methyltransferase domain
  misc_feature (17711)..(17942): Ribosomal protein L11 methyltransferase (Prm)
  misc_feature (17720)..(17873): Family of unknown function (DUF633)
  misc_feature (17720)..(17942): N2,N2-dimethylguanosine tRNA methyltransfera
  misc_feature (17726)..(17945): ubiE/COQ5 methyltransferase family
  misc_feature (18417)..(19128): Glutamate/Leucine/Phenylalanine/Valine dehyd
  misc_feature (19176)..(19560): Glu/Leu/Phe/Val dehydrogenase, dimerisation
  misc_feature (19757)..(19866): Iron-binding zinc finger CDGSH type
  misc_feature (20180)..(21189): Peptidase family M1
  misc_feature (20864)..(21255): Peptidase MA superfamily
  misc_feature (21413)..(22509): Domain of unknown function (DUF3458)
  misc_feature (22777)..(23095): Single-strand binding protein family
  misc_feature (23256)..(23368): AAA domain
  misc_feature (23286)..(23389): ABC transporter
  misc_feature (23307)..(23389): AAA domain
  misc_feature (24642)..(24805): ABC transporter
  misc_feature (25122)..(25840): ABC transporter
  misc_feature (25158)..(25210): P-loop containing region of AAA domain
  misc_feature (26109)..(26400): Ribosomal protein L17
  misc_feature (26544)..(26745): Bacterial RNA polymerase, alpha chain C termin
  misc_feature (26793)..(27408): RNA polymerase Rpb3/Rpb11 dimerisation domain
  misc_feature (27009)..(27315): RNA polymerase Rpb3/RpoA insert domain
  misc_feature (27707)..(27851): S4 domain
  misc_feature (27851)..(28136): Ribosomal protein S4/S9 N-terminal domain
  misc_feature (28148)..(28478): Ribosomal protein S11
  misc_feature (28630)..(28951): Ribosomal protein S13/S18
  misc_feature (28837)..(48912): IMS family HHH motif
  misc_feature (29310)..(30327): SecY translocase
  misc_feature (30539)..(30911): Ribosomal protein L18e/L15
  misc_feature (31009)..(31162): Ribosomal protein L30p/L7e
  misc_feature (31233)..(31455): Ribosomal protein S5, C-terminal domain
  misc_feature (31482)..(31680): Ribosomal protein S5, N-terminal domain
  misc_feature (31732)..(32071): Ribosomal L18p/L5e family
  misc_feature (32142)..(32370): Ribosomal protein L6
  misc_feature (32394)..(32607): Ribosomal protein L6
  misc_feature (32673)..(33051): Ribosomal protein S8
  misc_feature (33093)..(33261): Ribosomal protein S14p/S29e
  misc_feature (33416)..(33701): ribosomal L5P family C-terminus
  misc_feature (33707)..(33881): Ribosomal protein L5
  misc_feature (34191)..(34263): KOW motif
  misc_feature (34296)..(34665): Ribosomal protein L14p/L23e
  misc_feature (34758)..(34968): Ribosomal protein S17
  misc_feature (35023)..(35197): Ribosomal L29 protein
  misc_feature (35220)..(35607): Ribosomal protein L16p/L10e
  misc_feature (35657)..(35909): Ribosomal protein S3, C-terminal domain
  misc_feature (35930)..(36155): KH domain
  misc_feature (36014)..(36140): KH domain
  misc_feature (36286)..(36604): Ribosomal protein L22p/L17e
  misc_feature (36652)..(36898): Ribosomal protein S19
  misc_feature (37001)..(37385): Ribosomal Proteins L2, C-terminal domain
  misc_feature (37397)..(37634): Ribosomal Proteins L2, RNA binding domain
  misc_feature (37798)..(38071): Ribosomal protein L23
  misc_feature (38106)..(38670): Ribosomal protein L4/L1 family
  misc_feature (38753)..(39350): Ribosomal protein L3
  misc_feature (39432)..(39720): Ribosomal protein S10p/S20e
  misc_feature (39758)..(40046): Elongation factor Tu C-terminal domain
  misc_feature (40052)..(40265): Elongation factor Tu domain 2
  misc_feature (40331)..(40916): Elongation factor Tu GTP binding domain
  misc_feature (40535)..(40901): 50S ribosome-binding GTPase
  misc_feature (40973)..(41237): Elongation factor G C-terminus
  misc_feature (41237)..(41600): Elongation factor G, domain IV
  misc_feature (41597)..(41825): Elongation Factor G, domain II
  misc_feature (41858)..(42065): Elongation factor Tu domain 2
  misc_feature (42161)..(42998): Elongation factor Tu GTP binding domain
  misc_feature (43081)..(43534): Ribosomal protein S7p/S5e
  misc_feature (43584)..(43947): Ribosomal protein S12/S23
  misc_feature (44441)..(45258): tRNA synthetases class I (W and Y)
  misc_feature (45377)..(45486): S4 domain
  misc_feature (45812)..(46121): Iron-sulphur cluster biosynthesis
  misc_feature (46384)..(46987): Tetrapyrrole (Corrin/Porphyrin) Methylases
  misc_feature (47250)..(47943): Pyridoxal phosphate biosynthesis protein PdxJ
  misc_feature (48148)..(48326): Cytidine and deoxycytidylate deaminase zinc-
  misc_feature (48634)..(49423): pfkB family carbohydrate kinase
  misc_feature (49772)..(49920): DeoR C terminal sensor domain
  misc_feature (49898)..(50400): Ribose 5-phosphate isomerase A (phosphoribois)
  misc_feature (50683)..(50909): OB-fold nucleic acid binding domain
  misc_feature (50959)..(51971): tRNA synthetases class II (D, K and N)
  misc_feature (52175)..(52350): Protein of unknown function (DUF498/DUF598)
  misc_feature (52406)..(42958): tRNA (Guanine-1)-methyltransferase
  misc_feature (53067)..(53271): PRC-barrel domain
  misc_feature (53301)..(53541): RimM N-terminal domain
  misc_feature (53882)..(54357): D-alanyl-D-alanine carboxypeptidase
  misc_feature (53927)..(54375): Beta-lactamase enzyme family
  misc_feature (54602)..(54873): Penicillin-binding protein 5, C-terminal dom
  misc_feature (55198)..(56338): AMP-binding enzyme
  misc_feature (57298)..(57509): Sigma-70 region 2
  misc_feature (57826)..(57983): Sigma-70, region 4
  misc_feature (58097)..(58487): CNH domain
  misc_feature (58130)..(58601): Exonuclease
  misc_feature (58719)..(59148): SpoU rRNA Methylase family
  misc_feature (59214)..(59418): RNA 2'-O ribose methyltransferase substrate b
  misc_feature (60349)..(60514): RNA polymerase Rpb6
  misc_feature (60634)..(61177): Guanylate kinase
  misc_feature (60706)..(61174): AAA domain
  misc_feature (60754)..(61174): AAA domain
  misc_feature (60946)..(61177): AAA domain
  misc_feature (61372)..(61841): Inorganic pyrophosphatase
  misc_feature (62172)..(62505): Ribosomal protein L19
  misc_feature (62970)..(63417): MutL C terminal dimerisation domain
  misc_feature (63585)..(63942): DNA mismatch repair protein, C-terminal domai
  misc_feature (64173)..(64503): Histidine kinase-, DNA gyrase B-, and HSP90-l
  misc_feature (64305)..(64515): Histidine kinase-, DNA gyrase B-, and HSP90-l
  misc_feature (64971)..(65358): Radical SAM superfamily
  misc_feature (65139)..(65358): 4Fe-4S single cluster domain
  misc_feature (65151)..(65361): 4Fe-4S single cluster domain
  misc_feature (65810)..(66179): Ferrous iron transport protein B
  misc_feature (65825)..(66176): 50S ribosome-binding GTPase
  misc_feature (65912)..(66173): Signal recognition particle receptor beta subunit"
  misc_feature (65966)..(66173): Protein of unknown function, DUF258
  misc_feature (66029)..(66173): Dynamin family
  misc_feature (67167)..(68317): Amidinotransferase
  misc_feature (68333)..(69147): Amino acid kinase family
  misc_feature (69286)..(69793): Thiamine monophosphate synthase/TENI
  misc_feature (69946)..(70663): Phosphomethylpyrimidine kinase
  misc_feature (69991)..(70351): pfkB family carbohydrate kinase
  misc_feature (70749)..(71484): Thiazole biosynthesis protein ThiG
  misc_feature (71500)..(71677): ThiS family
  misc_feature (71757)..(72723): FAD dependent oxidoreductase
  misc_feature (72621)..(72720): Ketopantoate reductase PanE/ApbA
  misc_feature (73107)..(73344): Bacterial Fe(2+) trafficking
  misc_feature (73435)..(73744): NUDIX domain
  misc_feature (73789)..(73984): Angiotensin-converting enzyme
  misc_feature (73936)..(74335): HhH-GPD superfamily base excision DNA repair p
  misc_feature (74050)..(74143): Helix-hairpin-helix motif
  misc_feature (74475)..(75012): GTP cyclohydrolase I
  misc_feature (74607)..(74775): QueF-like protein
  misc_feature (75654)..(76344): ubiE/COQ5 methyltransferase family
  misc_feature (75699)..(76224): Methyltransferase domain
  misc_feature (75864)..(76209): Methyltransferase domain
  misc_feature (75897)..(76203): Methyltransferase domain
  misc_feature (75897)..(76209): Methyltransferase domain
  misc_feature (75897)..(76212): Methyltransferase domain
  misc_feature (75903)..(76203): Methyltransferase domain
  misc_feature (75909)..(76206): Methyltransferase domain
  misc_feature (76420)..(76510): Saposin-like type B, region 1
  misc_feature (76504)..(77635): Serine hydroxymethyltransferase
  misc_feature (76549)..(77413): Aminotransferase class I and II
  misc_feature (76801)..(77428): Beta-eliminating lyase
  misc_feature (76897)..(77428): Cys/Met metabolism PLP-dependent enzyme
  misc_feature (77805)..(78055): Ribosomal protein S20
  misc_feature (78102)..(78249): Membrane fusogenic activity
  misc_feature (78719)..(79029): AIR synthase related protein, N-terminal domain
  misc_feature (79142)..(79626): AIR synthase related protein, C-terminal domain
  misc_feature (79925)..(80151): AIR synthase related protein, N-terminal domain
  misc_feature (80318)..(80718): AIR synthase related protein, C-terminal domain
  misc_feature (80957)..(81249): AIR synthase related protein, N-terminal domain
  misc_feature (81353)..(81855): AIR synthase related protein, C-terminal domain
  misc_feature (81879)..(82582): CobB/CobQ-like glutamine amidotransferase do
  misc_feature (81972)..(82198): DJ-1/PfpI family
  misc_feature (81999)..(82168): Glutamine amidotransferase class-I
  misc_feature (83224)..(83963): SAICAR synthetase
  misc_feature (84159)..(84277): Glutamine amidotransferases class-II
  misc_feature (84333)..(84712): Glutamine amidotransferases class-II
  misc_feature (84333)..(84760): Glutamine amidotransferases class-II
  misc_feature (84336)..(84754): Glutamine amidotransferase domain
  misc_feature (84369)..(84805): Glutamine amidotransferase domain
  misc_feature (84453)..(84640): Ciliary BBSome complex subunit 2, N-terminal
  misc_feature (85158)..(85339): Phosphoribosyl transferase domain
  misc_feature (85621)..(86042): Aspartate/ornithine carbamoyltransferase, carbamoyl
  misc_feature (86059)..(86507): Aspartate/ornithine carbamoyltransferase, Asp/Orn b
  misc_feature (86538)..(86818): Aspartate carbamoyltransferase regulatory chain, al
  misc_feature (86823)..(86974): Aspartate carbamoyltransferase regulatory chain, me
  misc_feature (87144)..(87777): Polyprenyl synthetase
  misc_feature (88049)..(88286): DnaJ C terminal domain
  misc_feature (88313)..(88442): DnaJ C terminal domain
  misc_feature (88454)..(88640): DnaJ central domain
  misc_feature (88862)..(89054): DnaJ domain
  misc_feature (89215)..(91024): Hsp70 protein
  misc_feature (89899)..(90688): MreB/Mbl protein
  misc_feature (91102)..(91609): GrpE
  misc_feature (91878)..(92070): DNA gyrase B subunit, carboxyl terminus
  misc_feature (92673)..(93015): Toprim domain
  misc_feature (93096)..(93609): DNA gyrase B
  misc_feature (93753)..(94170): Histidine kinase-, DNA gyrase B-, and HSP90-li
  misc_feature (94017)..(94158): Histidine kinase-, DNA gyrase B-, and HSP90-li
  misc_feature (94375)..(94738): DNA polymerase III beta subunit, C-terminal
  misc_feature (94741)..(95083): DNA polymerase III beta subunit, central dom
  misc_feature (94771)..(65032): DNA polymerase III beta subunit, N-terminal
  misc_feature (95116)..(95479): DNA polymerase III beta subunit, N-terminal
  misc_feature (95679)..(95812): Ribosomal protein L34
  misc_feature (95706)..(95812): Protein of unknown function (DUF3049)
  misc_feature (95843)..(96153): Ribonuclease P
  misc_feature (96181)..(96374): Haemolytic domain
  misc_feature (96638)..(97449): YidC periplasmic domain
  misc_feature (97478)..(98028): 60Kd inner membrane protein
  misc_feature (98058)..(98404): GTP-binding protein TrmE N-terminus
  misc_feature (98697)..(98932): Protein of unknown function, DUF258
  misc_feature (98700)..(98809): Dynamin family
  misc_feature (98700)..(99046): 50S ribosome-binding GTPase
  misc_feature (98700)..(99052): Miro-like protein
  misc_feature (98700)..(99070): Ferrous iron transport protein B
  misc_feature (98703)..(98962): AAA domain
  misc_feature (98703)..(99112): Ras family
  misc_feature (99174)..(99391): Catalytic cysteine-containing C-terminus of GTP
  misc_feature (99505)..(99599): FAD binding domain
  misc_feature (99505)..(99599): FAD dependent oxidoreductase
  misc_feature (99505)..(99959): Pyridine nucleotide-disulphide oxidoreductase
  misc_feature (99505)..(100685): Glucose inhibited division protein A
  misc_feature (101125)..(101342): GidA associated domain 3
  misc_feature (101473)..(101651): FeoA domain
  misc_feature (101690)..(101892): Signal recognition particle receptor beta subunit
  misc_feature (101696)..(101898): Miro-like protein
  misc_feature (101696)..(102042): 50S ribosome-binding GTPase
  misc_feature (101696)..(102168): Ferrous iron transport protein B
  misc_feature (102761)..(103038): Nucleoside recognition
  misc_feature (103073)..(103227): Ferrous iron transport protein B C terminus
  misc_feature (103244)..(103806): Nucleoside recognition
  misc_feature (104115)..(105243): Na+/H+ antiporter 1
  misc_feature (105320)..(105614): DALR anticodon binding domain
  misc_feature (105716)..(106964): Glycyl-tRNA synthetase beta subunit
  misc_feature (106988)..(107165): Glycyl-tRNA synthetase beta subunit
  misc_feature (107200)..(108061): Glycyl-tRNA synthetase alpha subunit
  misc_feature (108258)..(108582): AIR synthase related protein, C-terminal domain
  misc_feature (108786)..(109071): AIR synthase related protein, N-terminal domain
  misc_feature (109381)..(109625): Glutamine synthetase, beta-Grasp domain
  misc_feature (109645)..(110477): Glutamine synthetase, catalytic domain
  misc_feature (110859)..(111898): Aminotransferase class I and II
  misc_feature (112088)..(113258): Amino acid permease
  misc_feature (112094)..(113270): Amino acid permease
  misc_feature (112511)..(113273): Spore germination protein
  misc_feature (113441)..(113903): Redoxin
  misc_feature (113549)..(113876): AhpC/TSA family
  misc_feature (114049)..(114607): Serine hydrolase (FSH1)
  misc_feature (114100)..(114607): Alpha/beta hydrolase family
  misc_feature (114100)..(114634): Phospholipase/Carboxylesterase
  misc_feature (114850)..(115154): Thioredoxin
  misc_feature (114880)..(115151): Mitosis protein DIM1
  misc_feature (114889)..(115085): Thioredoxin-like
  misc_feature (114901)..(114989): Thioredoxin-like
  misc_feature (114901)..(115034): Redoxin
  misc_feature (114901)..(115142): Thioredoxin-like domain
  misc_feature (114931)..(115076): Thioredoxin domain
  misc_feature (114961)..(115157): Thioredoxin-like domain
  misc_feature (115404)..(115528): Rho termination factor, N-terminal domain
  misc_feature (115533)..(115768): Rho termination factor, RNA-binding domain
  misc_feature (115866)..(116482): ATP synthase alpha/beta family, nucleotide-bind
  misc_feature (115896)..(116212): AAA domain
  misc_feature (115914)..(116212): ATPase family associated with various cellular
  misc_feature (116678)..(117951): 3-octaprenyl-4-hydroxybenzoate carboxy-lyase
  misc_feature (118237)..(118453): C-terminal, D2-small domain, of ClpB protein
  misc_feature (118456)..(118783): ATPase family associated with various cellul
  misc_feature (118465)..(118927): AAA domain (Cdc48 subfamily)
  misc_feature (119137)..(119365): AAA ATPase domain
  misc_feature (119143)..(119353): AAA domain
  misc_feature (119188)..(119356): AAA domain (Cdc48 subfamily)
  misc_feature (119200)..(119356): AAA domain
  misc_feature (119203)..(119353): ATPase family associated with various cellul
  misc_feature (119209)..(119353): AAA domain
  misc_feature (119242)..(119356): AAA domain (dynein-related subfamily)
  misc_feature (119248)..(119371): Zeta toxin
  misc_feature (119278)..(119488): MCM2/3/5 family
  misc_feature (119281)..(119359): Magnesium chelatase, subunit ChlI
  misc_feature (119535)..(120057): Proteasome subunit
  misc_feature (120212)..(120734): Aspartate/ornithine carbamoyltransferase, Asp/Orn b
  misc_feature (120749)..(121172): Aspartate/ornithine carbamoyltransferase, carbamoyl
  misc_feature (121340)..(121751): Uncharacterised protein family (UPF0081)
  misc_feature (121970)..(122717): UbiA prenyltransferase family
  misc_feature (123865)..(124232): MFS/sugar transport protein
  misc_feature (123937)..(125123): Major Facilitator Superfamily
  misc_feature (124081)..(125105): POT family
  misc_feature (124534)..(125258): Major Facilitator Superfamily
  misc_feature (125813)..(126140): Redoxin
  misc_feature (125819)..(126119): Thioredoxin-like domain
  misc_feature (125819)..(126194): AhpC/TSA family
  misc_feature (125831)..(126116): Thioredoxin-like
  misc_feature (126383)..(126770): AhpC/TSA family
  misc_feature (126386)..(126767): Redoxin
  misc_feature (126395)..(126692): Thioredoxin-like
  misc_feature (126984)..(127192): Thioesterase superfamily
  misc_feature (127531)..(127871): DJ-1/PfpI family
  misc_feature (129095)..(129833): Carbohydrate kinase
  misc_feature (129998)..(130439): YjeF-related protein N-terminus
  misc_feature (130751)..(131148): NUDIX domain
  misc_feature (131335)..(132844): TCP-1/cpn60 chaperonin family
  misc_feature (132970)..(133243): Chaperonin 10 Kd subunit
  misc_feature (133500)..(134251): Prolipoprotein diacylglyceryl transferase
  misc_feature (134314)..(135167): Glycoprotease family
  misc_feature (134722)..(135083): Carbamoyltransferase
  misc_feature (134824)..(135194): Tyrosyl-DNA phosphodiesterase
  misc_feature (135359)..(135743): 7, 8-dihydro-6-hydroxymethylpterin-pyrophosphokinase
  misc_feature (135914)..(136481): Uncharacterised protein family (UPF0259)
  misc_feature (136572)..(137628): Aminotransferase class I and II
  misc_feature (136845)..(137217): Alanine-glyoxylate amino-transferase
  misc_feature (137010)..(137442): Cys/Met metabolism PLP-dependent enzyme
  misc_feature (137115)..(137307): Beta-eliminating lyase
  misc_feature (137115)..(137418): DegT/DnrJ/EryC1/StrS aminotransferase family
  misc_feature (137115)..(137451): Aminotransferase class-V
  misc_feature (137969)..(138363): Type III restriction enzyme, res subunit
  misc_feature (138029)..(138093): Part of AAA domain
  misc_feature (138029)..(138150): AAA domain
  misc_feature (138029)..(138246): ATPase family associated with various cellul
  misc_feature (139319)..(139560): Helicase conserved C-terminal domain
  misc_feature (139580)..(139698): Ultra-violet resistance protein B
  misc_feature (139837)..(140059): YGGT family
  misc_feature (140119)..(140302): YGGT family
  misc_feature (140443)..(140755): Pyrroline-5-carboxylate reductase dimerisatio
  misc_feature (140941)..(141229): NADP oxidoreductase coenzyme F420-dependent
  misc_feature (141362)..(141813): YicC-like family, N-terminal region
  misc_feature (141959)..(142221): Domain of unknown function (DUF1732)
  misc_feature (142334)..(143973): tRNA synthetases class II (A)
  misc_feature (144275)..(144408): Threonyl and Alanyl tRNA synthetase second addi
  misc_feature (145089)..(145257): Bacterial regulatory proteins, luxR family
  misc_feature (145116)..(145278): ECF sigma factor
  misc_feature (145119)..(145260): Sigma-70, region 4
  misc_feature (145152)..(145260): Sigma-70, region 4
  misc_feature (146612)..(146880): Quinolinate phosphoribosyl transferase, N-ter
  misc_feature (146882)..(147378): Quinolinate phosphoribosyl transferase, C-ter
  misc_feature (147209)..(147342): Ribulose-phosphate 3 epimerase family
  misc_feature (147424)..(148544): FAD binding domain
  misc_feature (148690)..(148952): Fumarate reducatse flavoprotein C-term
  misc_feature (149106)..(150064): recA bacterial DNA recombination protein
  misc_feature (149187)..(149767): Rad51
  misc_feature (149205)..(149698): KaiC
  misc_feature (149223)..(149554): AAA domain
  misc_feature (149262)..(149527): Archaeal ATPase
  misc_feature (149271)..(149530): AAA domain
  misc_feature (149274)..(149614): ATPase family associated with various cellular a
  misc_feature (149274)..(149662): Cobinamide kinase / cobinamide phosphate guanylt
  misc_feature (150273)..(150634): Ribosomal protein L13
  misc_feature (150694)..(151058): Ribosomal protein S9/S16
  misc_feature (151114)..(151265): Glutaredoxin
  misc_feature (151117)..(151322): Glutathione S-transferase, N-terminal domain
  misc_feature (151117)..(151340): Glutathione S-transferase, N-terminal domain
  misc_feature (151132)..(151322): Glutathione S-transferase, N-terminal domain
  misc_feature (151381)..(151664): Glutathione S-transferase, C-terminal domain
  misc_feature (151453)..(151643): Glutathione S-transferase, C-terminal domain
  misc_feature (151779)..(152083): Stringent starvation protein B
  misc_feature (152523)..(153825): Amino acid permease
  misc_feature (152592)..(153840): Amino acid permease
  misc_feature (154062)..(154213): Type II/IV secretion system protein
  misc_feature (154083)..(154210): Sigma-54 interaction domain
  misc_feature (154104)..(154456): Uncharacterised P-loop hydrolase UPF0079
  misc_feature (154146)..(154273): AAA domain
  misc_feature (154146)..(154321): RNA helicase
  misc_feature (154744)..(155626): Amidohydrolase family
  misc_feature (155759)..(156263): Telomere recombination
  misc_feature (156552)..(157365): NADH-Ubiquinone/plastoquinone (complex I), vario
  misc_feature (158032)..(158881): NADH-Ubiquinone/plastoquinone (complex I), vario
  misc_feature (159991)..(160840): NADH-Ubiquinone/plastoquinone (complex I), var
  misc_feature (160870)..(161044): NADH-Ubiquinone oxidoreductase (complex I), ch
  misc_feature (161282)..(161462): NADH-ubiquinone/plastoquinone oxidoreductase
  misc_feature (161686)..(162130): NADH-ubiquinone/plastoquinone oxidoreductase c
  misc_feature (162308)..(162410): 4Fe-4S double cluster binding domain
  misc_feature (162317)..(162419): 4Fe-4S dicluster domain
  misc_feature (162347)..(162410): 4Fe-4S dicluster domain
  misc_feature (162356)..(162410): 4Fe-4S binding domain
  misc_feature (162356)..(162425): 4Fe-4S binding domain
  misc_feature (162356)..(462428): 4Fe-4S dicluster domain
  misc_feature (162356)..(162527): 4Fe-4S dicluster domain
  misc_feature (162356)..(162533): 4Fe-4S dicluster domain
  misc_feature (162359)..(162527): 4Fe-4S dicluster domain
  misc_feature (162362)..(162527): 4Fe-4S double cluster binding domain
  misc_feature (162362)..(262527): 4Fe-4S dicluster domain
  misc_feature (162365)..(162431): 4Fe-4S binding domain
  misc_feature (162368)..(162533): 4Fe-4S dicluster domain
  misc_feature (162470)..(162533): 4Fe-4S binding domain
  misc_feature (162470)..(162545): 4Fe-4S dicluster domain
  misc_feature (162473)..(162533): 4Fe-4S binding domain
  misc_feature (162479)..(162530): 4Fe-4S dicluster domain
  misc_feature (162479)..(162590): 4Fe-4S dicluster domain
  misc_feature (162482)..(462530): 4Fe-4S binding domain
  misc_feature (162482)..(162533): 4Fe-4S binding domain
  misc_feature (162779)..(163733): NADH dehydrogenase
  misc_feature (164209)..(165337): Molybdopterin oxidoreductase
  misc_feature (165778)..(156904): NADH-ubiquinone oxidoreductase-G iron-sulfur
  misc_feature (165925)..(166153): 2Fe-2S iron-sulfur cluster binding domain
  misc_feature (165949)..(166138): 2Fe-2S iron-sulfur cluster binding domain
  misc_feature (166314)..(166452): NADH-ubiquinone oxidoreductase-F iron-sulfur
  misc_feature (166563)..(166713): SLBB domain
  misc_feature (166779)..(167298): Respiratory-chain NADH dehydrogenase 51 Kd s
  misc_feature (167449)..(167893): Thioredoxin-like [2Fe-2S] ferredoxin
  misc_feature (167983)..(168667): Respiratory-chain NADH dehydrogenase, 49 Kd s
  misc_feature (168694)..(168871): Respiratory-chain NADH dehydrogenase, 49 Kd s
  misc_feature (169399)..(169774): Respiratory-chain NADH dehydrogenase, 30 Kd s
  misc_feature (169964)..(170297): NADH ubiquinone oxidoreductase, 20 Kd subunit
  misc_feature (170392)..(170668): NADH-ubiquinone/plastoquinone oxidoreductase, ch
  misc_feature (171059)..(171278): Preprotein translocase SecG subunit
  misc_feature (171412)..(141781): DALR anticodon binding domain
  misc_feature (171904)..(172870): tRNA synthetases class I (R)
  misc_feature (172888)..(173101): Arginyl tRNA synthetase N terminal domain
  misc_feature (173424)..(173617): 'Cold-shock' DNA-binding domain
  misc_feature (173451)..(173524): Ribonuclease B OB domain
  misc_feature (173949)..(174441): Radical SAM superfamily
  misc_feature (174868)..(175183): Biotin/lipoate A/B protein ligase family
  misc_feature (175358)..(175610): Protein of unknown function (DUF493)
  misc_feature (175774)..(176065): Oligomerisation domain
  misc_feature (176472)..(177075): SRP54-type protein, GTPase domains
  misc_feature (176709)..(177072): ABC transporter
  misc_feature (176733)..(177072): 50S ribosome-binding GTPase
  misc_feature (176781)..(177072): ATPase family associated with various cellul
  misc_feature (176841)..(177072): AAA domain
  misc_feature (176961)..(177072): Part of AAA domain
  misc_feature (176976)..(177072): Molybdopterin guanine dinucleotide synthesis
  misc_feature (176982)..(177075): AAA domain
  misc_feature (177141)..(177345): SRP54-type protein, helical bundle domain
  misc_feature (177542)..(178190): ATP-NAD kinase
  misc_feature (178384)..(178822): NAD-dependent glycerol-3-phosphate dehydrogen
  misc_feature (178879)..(179335): NAD-dependent glycerol-3-phosphate dehydrogen
  misc_feature (179050)..(179335): Ketopantoate reductase PanE/ApbA
  misc_feature (179386)..(179812): Preprotein translocase subunit SecB
  misc_feature (179840)..(180026): SH3-binding, glutamic acid-rich protein
  misc_feature (179888)..(180062): Glutathione S-transferase, N-terminal domain
  misc_feature (179888)..(180071): Glutaredoxin
  misc_feature (179900)..(180062): Thioredoxin
  misc_feature (179924)..(180062): Thioredoxin-like domain
  misc_feature (180121)..(180394): Rhodanese-like domain
  misc_feature (180599)..(180815): BolA-like protein
  misc_feature (181120)..(181250): S4 domain
  misc_feature (181312)..(181715): RNA pseudouridylate synthase
  misc_feature (181899)..(182197): Cytidine and deoxycytidylate deaminase zinc-
  misc_feature (181953)..(182263): APOBEC-like N-terminal domain
  misc_feature (182337)..(182968): RibD C-terminal domain
  misc_feature (183026)..(183276): Lumazine binding domain
  misc_feature (183314)..(183570): Lumazine binding domain
  misc_feature (183865)..(183971): Cytidylyltransferase
  misc_feature (184462)..(184814): NUDIX domain
  misc_feature (184886)..(185334): Crossover junction endodeoxyribonuclease RuvC
  misc_feature (185454)..(185641): RuvA N terminal domain
  misc_feature (185661)..(185830): Helix-hairpin-helix domain
  misc_feature (185754)..(185833): Helix-hairpin-helix motif
  misc_feature (185934)..(186052): RuvA, C-terminal domain
  misc_feature (186151)..(187078): Quinolinate synthetase A protein
  misc_feature (187303)..(187691): Malic enzyme, N-terminal domain
  misc_feature (187726)..(188438): Malic enzyme, NAD binding domain
  misc_feature (187801)..(188006): ThiF family
  misc_feature (187969)..(188123): S-adenosyl-L-homocysteine hydrolase, NAD bin
  misc_feature (188555)..(188973): lactate/malate dehydrogenase, NAD binding dom
  misc_feature (188837)..(188976): Family 4 glycosyl hydrolase
  misc_feature (188984)..(189474): lactate/malate dehydrogenase, alpha/beta C-te
  misc_feature (189592)..(190018): OmpA-like transmembrane domain
  misc_feature (189601)..(190093): Outer membrane protein beta-barrel domain
  misc_feature (190266)..(191325): tRNA methyl transferase
  misc_feature (190737)..(191325): Queuosine biosynthesis protein QueC
  misc_feature (191073)..(191325): Asparagine synthase
  misc_feature (191097)..(191328): NAD synthase
  misc_feature (191175)..(191325): Thiamine biosynthesis protein (ThiI)
  misc_feature (191646)..(192715): Isocitrate/isopropylmalate dehydrogenase
  misc_feature (192796)..(192997): Translation initiation factor 1A / IF-1
  misc_feature (193302)..(193704): HhH-GPD superfamily base excision DNA repair p
  misc_feature (193419)..(493494): Helix-hairpin-helix motif
  misc_feature (193997)..(194102): 4Fe-4S dicluster domain
  misc_feature (194000)..(194192): 4Fe-4S dicluster domain
  misc_feature (194021)..(194093): 4Fe-4S dicluster domain
  misc_feature (194036)..(194204): 4Fe-4S dicluster domain
  misc_feature (194039)..(194105): 4Fe-4S binding domain
  misc_feature (194048)..(194099): 4Fe-4S binding domain
  misc_feature (194051)..(194102): 4Fe-4S binding domain
  misc_feature (194054)..(194201): 4Fe-4S dicluster domain
  misc_feature (194120)..(194183): 4Fe-4S double cluster binding domain
  misc_feature (194132)..(194201): 4Fe-4S binding domain
  misc_feature (194132)..(194207): 4Fe-4S binding domain
  misc_feature (194132)..(194381): 4Fe-4S dicluster domain
  misc_feature (194135)..(194183): 4Fe-4S binding domain
  misc_feature (194135)..(194381): 4Fe-4S dicluster domain
  misc_feature (194138)..(194381): 4Fe-4S dicluster domain
  misc_feature (194141)..(194189): 4Fe-4S binding domain
  misc_feature (194141)..(194198): 4Fe-4S binding domain
  misc_feature (194288)..(194390): Putative Fe-S cluster
  misc_feature (194856)..(195136): PCRF domain
  misc_feature (195237)..(195565): RF-1 domain
  misc_feature (195706)..(196567): RmuC family
  misc_feature (197179)..(201773): Bacterial NAD-glutamate dehydrogenase
  misc_feature (201807)..(202080): GMP synthase C terminal domain
  misc_feature (202179)..(202695): Phosphoadenosine phosphosulfate reductase fami
  misc_feature (202212)..(202698): PP-loop family
  misc_feature (202500)..(202740): NAD synthase
  misc_feature (202530)..(202704): Thiamine biosynthesis protein (ThiI)
  misc_feature (202533)..(202698): tRNA methyl transferase
  misc_feature (202782)..(203325): Glutamine amidotransferase class-I
  misc_feature (202827)..(203130): Peptidase C26
  misc_feature (203415)..(204813): IMP dehydrogenase / GMP reductase domain
  misc_feature (203718)..(204741): Nitronate monooxygenase
  misc_feature (203742)..(204102): FMN-dependent dehydrogenase
  misc_feature (203748)..(204021): Conserved region in glutamate synthase
  misc_feature (204228)..(204393): CBS domain
  misc_feature (204414)..(204552): CBS domain
  misc_feature (205000)..(205355): Tetrahydrofolate dehydrogenase/cyclohydrolase
  misc_feature (205360)..(205838): Tetrahydrofolate dehydrogenase/cyclohydrolase
  misc_feature (205949)..(206867): Asparaginase
  misc_feature (206974)..(207664): Metallopeptidase family M24
  misc_feature (207880)..(208529): Ribosomal protein S2
  misc_feature (208736)..(208836): UBA/TS-N domain
  misc_feature (208883)..(209538): Elongation factor TS
  misc_feature (208976)..(209193): Protein of unknown function (DUF3414)
  misc_feature (209619)..(210247): Amino acid kinase family
  misc_feature (210387)..(210871): Ribosome recycling factor
  misc_feature (210931)..(211694): Cytidylyltransferase family
  misc_feature (211872)..(212536): Holliday junction DNA helicase ruvB N-termin
  misc_feature (211998)..(212233): AAA domain
  misc_feature (211998)..(212368): ATPase family associated with various cellul
  misc_feature (212589)..(212812): Holliday junction DNA helicase ruvB C-termin
  misc_feature (212983)..(213290): DnaB-like helicase N terminal domain
  misc_feature (213508)..(214061): AAA domain
  misc_feature (213520)..(214295): DnaB-like helicase C terminal domain
  misc_feature (213523)..(214067): KaiC
  misc_feature (213571)..(214058): GvpD gas vesicle protein
  misc_feature (214934)..(215367): Bacterial trigger factor protein (TF)
  misc_feature (215405)..(215646): FKBP-type peptidyl-prolyl cis-trans isomeras
  misc_feature (215711)..(216141): Bacterial trigger factor protein (TF) C-term
  misc_feature (216301)..(216839): Clp protease
  misc_feature (216962)..(217077): ClpX C4-type zinc finger
  misc_feature (217136)..(217503): MCM2/3/5 family
  misc_feature (217139)..(217506): Holliday junction DNA helicase ruvB N-termin
  misc_feature (217193)..(217335): Rad17 cell cycle checkpoint protein
  misc_feature (217214)..(217500): Sigma-54 interaction domain
  misc_feature (217250)..(2017320): IstB-like ATP binding protein
  misc_feature (217253)..(217332): Magnesium chelatase, subunit ChlI
  misc_feature (217253)..(217491): AAA domain
  misc_feature (217253)..(217848): AAA domain (Cdc48 subfamily)
  misc_feature (217253)..(217878): AAA ATPase domain
  misc_feature (217256)..(217491): AAA domain
  misc_feature (217259)..(217335): ABC transporter
  misc_feature (217259)..(217497): AAA domain (dynein-related subfamily)
  misc_feature (217262)..(217578): ATPase family associated with various cellul
  misc_feature (217265)..(217473): AAA domain
  misc_feature (217862)..(218088): C-terminal, D2-small domain, of ClpB protein
  misc_feature (218261)..(218847): ATP-dependent protease La (LON) domain
  misc_feature (219215)..(219417): AAA ATPase domain
  misc_feature (219293)..(219438): AAA domain
  misc_feature (219296)..(219672): AAA domain (dynein-related subfamily)
  misc_feature (219296)..(219708): ATPase family associated with various cellular act
  misc_feature (219308)..(219672): ATPase family associated with various cellular act
  misc_feature (219950)..(220560): Lon protease (S16) C-terminal proteolytic domain
  misc_feature (220256)..(220464): Subunit ChlI of Mg-chelatase
  misc_feature (220716)..(221119): SurA N-terminal domain
  misc_feature (220716)..(221158): SurA N-terminal domain
  misc_feature (220842)..(221167): SurA N-terminal domain
  misc_feature (222453)..(223099): Orotidine 5'-phosphate decarboxylase / HUMPS famil
  misc_feature (223235)..(223395): Global regulator protein family
  misc_feature (223651)..(224002): Adenylosuccinate lyase C-terminal
  misc_feature (224053)..(224815): Lyase
  misc_feature (225067)..(225406): Phosphoribosyl synthetase-associated domain
  misc_feature (225262)..(225559): Phosphoribosyl transferase domain
  misc_feature (225643)..(225997): N-terminal domain of ribose phosphate pyropho
  misc_feature (226329)..(226881): Formyl transferase
  misc_feature (226925)..(227192): Phosphoribosylglycinamide synthetase, C domain
  misc_feature (227288)..(227873): Phosphoribosylglycinamide synthetase, ATP-grasp
  misc_feature (227300)..(227786): ATP-grasp domain
  misc_feature (227870)..(228173): Phosphoribosylglycinamide synthetase, N domain
  misc_feature (228384)..(228715): MGS-like domain
  misc_feature (228732)..(229675): AICARFT/IMPCHase bienzyme
  misc_feature (229977)..(230413): AIR carboxylase
  misc_feature (230742)..(321235): ATP-grasp domain
  misc_feature (230760)..(231268): ATP-grasp domain
  misc_feature (231685)..(232063): Acyltransferase
  misc_feature (234212)..(235130): Bacterial fructose-1,6-bisphosphatase, glpX-enco
  misc_feature (235345)..(325895): Putative methyltransferase
  misc_feature (235393)..(235586): Methyltransferase domain
  misc_feature (235393)..(235607): Methyltransferase domain
  misc_feature (235997)..(236121): UDP-glucose/GDP-mannose dehydrogenase family
  misc_feature (236000)..(236208): NADP oxidoreductase coenzyme F420-dependent
  misc_feature (236000)..(236262): NAD-dependent glycerol-3-phosphate dehydroge
  misc_feature (236000)..(236274): Putative NAD(P)-binding
  misc_feature (236003)..(236313): TrkA-N domain
  misc_feature (236456)..(236667): TrkA-C domain
  misc_feature (236693)..(237048): TrkA-N domain
  misc_feature (237164)..(237354): TrkA-C domain
  misc_feature (237916)..(238181): Cation transport protein
  misc_feature (238299)..(238825): Cation transport protein
  misc_feature (239038)..(239482): Major Facilitator Superfamily
  misc_feature (239071)..(239980): Sugar (and other) transporter
  misc_feature (239077)..(240124): Major Facilitator Superfamily
  misc_feature (240610)..(240995): Mitochondrial PGP phosphatase
  misc_feature (240859)..(240992): HAD-hyrolase-like
  misc_feature (241195)..(242096): tRNA synthetases class I (E and Q), catalytic d
  misc_feature (243109)..(243692): Beta-ketoacyl synthase, N-terminal domain
  misc_feature (243757)..(244085): Beta-ketoacyl synthase, C-terminal domain
  misc_feature (245148)..(245419): Rhodanese-like domain
  misc_feature (245705)..(245976): CDP-alcohol phosphatidyltransferase
  misc_feature (246927)..(247446): UbiA prenyltransferase family
  misc_feature (247552)..(247810): Prokaryotic Cytochrome C oxidase subunit IV
  misc_feature (247869)..(248409): Cytochrome c oxidase subunit III
  misc_feature (248916)..(250275): Cytochrome C and Quinol oxidase polypeptide I
  misc_feature (250506)..(250620): COX Aromatic Rich Motif
  misc_feature (250677)..(250908): Cytochrome C oxidase subunit II, periplasmic domai
  misc_feature (251037)..(251241): Cytochrome C oxidase subunit II, transmembrane dom
  misc_feature (251835)..(253011): Tryptophan/tyrosine permease family
  misc_feature (253128)..(254302): Tryptophan/tyrosine permease family
  misc_feature (254572)..(254825): FtsH Extracellular
  misc_feature (255094)..(255227): TIP49 C-terminus
  misc_feature (255109)..(255233): Zeta toxin
  misc_feature (255118)..(255182): Magnesium chelatase, subunit ChlI
  misc_feature (255124)..(255227): AAA domain
  misc_feature (255124)..(255491): AAA domain (dynein-related subfamily)
  misc_feature (255124)..(255524): ATPase family associated with various cellular
  misc_feature (255703)..(256346): Peptidase family M41
  misc_feature (256162)..(156355): Hinge domain of cleavage stimulation factor su
  misc_feature (256434)..(257083): Pterin binding enzyme
  misc_feature (257163)..(258881): Triosephosphate isomerase
  misc_feature (257405)..(257607): Rossmann-like domain
  misc_feature (257651)..(258033): Domain of unknown function (DUF2520)
  misc_feature (259288)..(259481): Holliday junction DNA helicase ruvB N-termin
  misc_feature (259324)..(259469): AAA ATPase domain
  misc_feature (259327)..(259805): DNA polymerase III, delta subunit
  misc_feature (259390)..(259820): AAA domain
  misc_feature (259393)..(259739): AAA domain
  misc_feature (259393)..(259784): ATPase family associated with various cellul
  misc_feature (259642)..(259943): TIP49 C-terminus
  misc_feature (259963)..(260342): DNA polymerase III subunits gamma and tau do
  misc_feature (260703)..(261469): D-isomer specific 2-hydroxyacid dehydrogenase
  misc_feature (260988)..(261400): D-isomer specific 2-hydroxyacid dehydrogenase
  misc_feature (260997)..(261076): NADP oxidoreductase coenzyme F420-dependent
  misc_feature (261800)..(262164): Histidine kinase-, DNA gyrase B-, and HSP90-like
  misc_feature (261815)..(262272): Histidine kinase-, DNA gyrase B-, and HSP90-like
  misc_feature (262283)..(262425): Hsp90 protein
  misc_feature (262361)..(263640): Hsp90 protein
  misc_feature (263711)..(263834): Helix-turn-helix
  misc_feature (263714)..(263825): Winged helix-turn helix
  misc_feature (263723)..(263798): Helix-turn-helix domain
  misc_feature (263726)..(263828): CENP-B N-terminal DNA-binding domain
  misc_feature (263741)..(263834): Homeodomain-like domain
  misc_feature (263741)..(263837): Helix-turn-helix domain
  misc_feature (263741)..(263840): Helix-turn-helix domain
  misc_feature (263741)..(263849): Transposase
  misc_feature (263900)..(264257): Resolvase, N terminal domain
  misc_feature (264011)..(264257): Poxvirus F16 protein
  misc_feature (264478)..(265507): Sodium/hydrogen exchanger family
  misc_feature (266000)..(266142): Rubredoxin
  misc_feature (266186)..(266522): Pyridine nucleotide-disulphide oxidoreductase
  misc_feature (266609)..(267521): Pyridine nucleotide-disulphide oxidoreductase
  misc_feature (266801)..(267026): Pyridine nucleotide-disulphide oxidoreductase
  misc_feature (266912)..(267152): L-lysine 6-monooxygenase (NADPH-requiring)
  misc_feature (266933)..(267515): Pyridine nucleotide-disulphide oxidoreductase
  misc_feature (267380)..(267527): Thi4 family
  misc_feature (267392)..(267521): FAD dependent oxidoreductase
  misc_feature (267404)..(267521): FAD binding domain
  misc_feature (267410)..(267521): FAD dependent oxidoreductase
  misc_feature (267579)..(268341): Type I GTP cyclohydrolase folE2
  misc_feature (268748)..(268890): Biotin-lipoyl like
  misc_feature (268751)..(268905): HlyD family secretion protein
  misc_feature (269033)..(269343): HlyD family secretion protein
  misc_feature (269725)..(272735): AcrB/AcrD/AcrF family
  misc_feature (270709)..(271154): Protein export membrane protein
  misc_feature (273193)..(274106): MraW methylase family
  misc_feature (273241)..(273920): Methyltransferase domain
  misc_feature (274392)..(274798): Uncharacterised BCR, YhbC family COG0779
  misc_feature (274851)..(275227): NusA N-terminal domain
  misc_feature (275247)..(275431): S1 RNA binding domain
  misc_feature (275538)..(275746): NusA-like KH domain
  misc_feature (275712)..(275851): KH domain
  misc_feature (275940)..(276085): Helix-hairpin-helix domain
  misc_feature (276129)..(276298): Helix-hairpin-helix domain
  misc_feature (276379)..(276500): Translation initiation factor IF-2, N-terminal r
  misc_feature (276544)..(276644): Bacterial translation initiation factor IF-2 ass
  misc_feature (277330)..(277811): Elongation factor Tu GTP binding domain
  misc_feature (277336)..(277661): Miro-like protein
  misc_feature (277891)..(278066): Elongation factor Tu domain 2
  misc_feature (278182)..(278510): Translation-initiation factor 2
  misc_feature (278599)..(278801): Elongation factor Tu domain 2
  misc_feature (278869)..(279173): Ribosome-binding factor A
  misc_feature (279366)..(279760): TruB family pseudouridylate synthase (N terminal do
  misc_feature (280206)..(280695): rRNA small subunit methyltransferase G
  misc_feature (280260)..(280557): Methyltransferase domain
  misc_feature (280329)..(280575): Methyltransferase small domain
  misc_feature (280416)..(280566): Putative methyltransferase
  misc_feature (280907)..(281196): Oxidoreductase FAD-binding domain
  misc_feature (281231)..(281547): Oxidoreductase NAD-binding domain
  misc_feature (282041)..(252969): Homocysteine S-methyltransferase
  misc_feature (283061)..(283698): Pterin binding enzyme
  misc_feature (283985)..(284193): B12 binding domain
  misc_feature (284231)..(284505): B12 binding domain
  misc_feature (284807)..(285621): Vitamin B12 dependent methionine synthase, ac
  misc_feature (285809)..(286413): O-methyltransferase
  misc_feature (285947)..(286269): Methyltransferase domain
  misc_feature (285950)..(286275): Methyltransferase domain
  misc_feature (286578)..(286680): Hexapeptide repeat of succinyl-transferase
  misc_feature (286578)..(286686): Bacterial transferase hexapeptide (six repeats)
  misc_feature (286635)..(286734): Bacterial transferase hexapeptide (six repeats)
  misc_feature (286830)..(286938): Bacterial transferase hexapeptide (six repeats)
  misc_feature (287064)..(287449): Flavoprotein
  misc_feature (287067)..(287398): Nitrate reductase gamma subunit
  misc_feature (287606)..(288141): DNA / pantothenate metabolism flavoprotein
  misc_feature (288279)..(288682): dUTPase
  misc_feature (289178)..(290069): dUTPase
  misc_feature (290331)..(291951): Ribonucleotide reductase, barrel domain
  misc_feature (291960)..(292179): Ribonucleotide reductase, all-alpha domain
  misc_feature (292650)..(292941): ATP cone domain
  misc_feature (293062)..(293368): Iron/manganese superoxide dismutases, C-terminal do
  misc_feature (293242)..(293533): GSCFA family
  misc_feature (293404)..(293644): Iron/manganese superoxide dismutases, alpha-hairpin
  misc_feature (293810)..(294006): Glutaredoxin
  misc_feature (294217)..(295582): Aldehyde dehydrogenase family
  misc_feature (295822)..(296746): Proline dehydrogenase
  misc_feature (296746)..(297088): DNA-binding domain of Proline dehydrogenase
  misc_feature (297558)..(297829): CDP-alcohol phosphatidyltransferase
  misc_feature (299294)..(300078): Elongation factor Tu GTP binding domain
  misc_feature (299300)..(299685): 50S ribosome-binding GTPase
  misc_feature (299306)..(299691): Miro-like protein
  misc_feature (300185)..(300387): Elongation factor Tu domain 2
  misc_feature (300470)..(300633): Elongation Factor G, domain II
  misc_feature (300926)..(301245): AAA domain
  misc_feature (300929)..(301017): ATPase family associated with various cellular ac
  misc_feature (300929)..(301044): AAA domain
  misc_feature (300929)..(301290): AAA domain
  misc_feature (300935)..(301476): Adenylate kinase
  misc_feature (301283)..(301392): Adenylate kinase, active site lid
  misc_feature (301818)..(302500): Polyprenyl synthetase
  misc_feature (302744)..(303189): AAA domain
  misc_feature (302747)..(303168): ATPase MipZ
  misc_feature (302750)..(302859): Anion-transporting ATPase
  misc_feature (302750)..(303387): CobQ/CobB/MinD/ParA nucleotide binding domain
  misc_feature (302762)..(303183): YhjQ protein
  misc_feature (303586)..(303755): Calmodulin binding domain
  misc_feature (303607)..(303815): Septum formation topological specificity factor Min
  misc_feature (304187)..(304449): Calcineurin-like phosphoesterase superfamily d
  misc_feature (304190)..(304584): Calcineurin-like phosphoesterase
  misc_feature (305062)..(305485): Conserved hypothetical protein 95
  misc_feature (305110)..(305413): Spermine/spermidine synthase
  misc_feature (305125)..(305473): Methyltransferase domain
  misc_feature (305152)..(305467): Methyltransferase domain
  misc_feature (305215)..(305419): Probable N6-adenine methyltransferase
  misc_feature (305221)..(305482): Methyltransferase small domain
  misc_feature (305230)..(305470): Methyltransferase domain
  misc_feature (305233)..(305473): RNA cap guanine-N2 methyltransferase
  misc_feature (305356)..(305479): DNA methylase
  misc_feature (305827)..(306023): Ribosomal protein S15
  misc_feature (306183)..(306511): 3' exoribonuclease family, domain 1
  misc_feature (306570)..(306763): 3' exoribonuclease family, domain 2
  misc_feature (306855)..(307111): Polyribonucleotide nucleotidyltransferase, RNA bi
  misc_feature (307119)..(307519): 3' exoribonuclease family, domain 1
  misc_feature (307527)..(307738): 3' exoribonuclease family, domain 2
  misc_feature (307815)..(307987): KH domain
  misc_feature (307839)..(307924): KH domain
  misc_feature (308001)..(308215): S1 RNA binding domain
  misc_feature (308381)..(308936): OmpA-like transmembrane domain
  misc_feature (308444)..(308930): Outer membrane protein beta-barrel domain
  misc_feature (309323)..(309839): Major Facilitator Superfamily
  misc_feature (309326)..(310322): MFS/sugar transport protein
  misc_feature (309458)..(310463): Major Facilitator Superfamily
  misc_feature (310684)..(310919): SRP54-type protein, helical bundle domain
  misc_feature (310957)..(311102): Zeta toxin
  misc_feature (310975)..(311573): SRP54-type protein, GTPase domain
  misc_feature (311662)..(311957): Signal peptide binding domain
  misc_feature (312121)..(312308): Ribosomal protein S16
  misc_feature (312383)..(312938): Maf-like protein
  misc_feature (313099)..(313381): Anticodon binding domain
  misc_feature (313714)..(314200): tRNA synthetase class II core domain (G, H, P
  misc_feature (314646)..(314899): OB-fold nucleic acid binding domain
  misc_feature (314946)..(316279): tRNA synthetases class II (D, K and N)
  misc_feature (315219)..(315403): tRNA synthetase class II core domain (G, H,
  misc_feature (315540)..(315820): GAD domain
  misc_feature (316408)..(317117): Transcriptional regulator
  misc_feature (317564)..(319089): Aconitase family (aconitate hydratase)
  misc_feature (319469)..(319854): Aconitase C-terminal domain
  misc_feature (320569)..(320903): PCRF domain
  misc_feature (320992)..(321332): RF-1 domain
  misc_feature (321466)..(322018): Peptidyl-tRNA hydrolase
  misc_feature (322081)..(322342): Ribosomal protein TL5, C-terminal domain
  misc_feature (322360)..(322630): Ribosomal L25p family
  misc_feature (322698)..(323016): Biotin carboxylase C-terminal domain
  misc_feature (323055)..(323676): Carbamoyl-phosphate synthase L chain, ATP bi
  misc_feature (323055)..(323910): ATP-grasp in the biosynthetic pathway with T
  misc_feature (323085)..(323679): RimK-like ATP-grasp domain
  misc_feature (323136)..(323676): ATP-grasp domain
  misc_feature (323139)..(323676): ATP-grasp domain
  misc_feature (323142)..(323589): ATP-grasp domain
  misc_feature (323145)..(323598): D-ala D-ala ligase C-terminus
  misc_feature (323685)..(324018): Carbamoyl-phosphate synthase L chain, N-term
  misc_feature (324067)..(324289): Biotin-requiring enzyme
  misc_feature (324951)..(325716): TatD related DNase
  misc_feature (326287)..(326722): DNA polymerase III, delta subunit
  misc_feature (326293)..(326659): ATPase family associated with various cellul
  misc_feature (327154)..(327557): Hemerythrin HHE cation binding domain
  misc_feature (328454)..(328938): O-methyltransferase
  misc_feature (328550)..(328755): Protein-L-isoaspartate(D-aspartate) O-methyl
  misc_feature (328550)..(328884): Met-10+ like-protein
  misc_feature (328550)..(328998): ubiE/COQ5 methyltransferase family
  misc_feature (328553)..(328902): Methyltransferase small domain
  misc_feature (328559)..(328758): O-methyltransferase
  misc_feature (328571)..(329046): Methyltransferase domain
  misc_feature (328577)..(328803): Putative methyltransferase
  misc_feature (328580)..(328764): Ribosomal protein L11 methyltransferase (Prm
  misc_feature (328586)..(328887): Methyltransferase domain
  misc_feature (328586)..(328893): Methyltransferase domain
  misc_feature (328586)..(328893): Mitochondrial small ribosomal subunit Rsm22
  misc_feature (328586)..(329007): RNA cap guanine-N2 methyltransferase
  misc_feature (328592)..(328881): Methyltransferase domain
  misc_feature (328592)..(328884): Methyltransferase domain
  misc_feature (328592)..(328893): Methyltransferase domain
  misc_feature (329150)..(330042): Condensation domain
  misc_feature (329162)..(329194): NRPS/PKS Motif: C1_LCL_004-017 (e-value: 0.024, bit-score: 7.6)
  misc_feature (329216)..(329326): "NRPS/PKS Motif: C2_LCL_024-062 (e-value: 2.2e-13, bit-score: 42.6
  misc_feature (329543)..(329608): NRPS/PKS Motif: C3_LCL_132-143 (e-value: 4.9e-08, bit-score: 25.5)
  misc_feature (329945)..(330028): NRPS/PKS Motif: C5_LCL_267-296 (e-value: 5.9e-09, bit-score: 28.4)
  misc_feature (330158)..(330360): HxxPF-repeated domain
  misc_feature (330761)..(330945): Phosphopantetheine attachment site
  misc_feature (331127)..(331944): Condensation domain
  misc_feature (332096)..(332349): HxxPF-repeated domain
  misc_feature (332525)..(333726): AMP-binding enzyme
  misc_feature (332714)..(332755): NRPS/PKS Motif: NRPS-A_a2 (e-value: 0.0024, bit-score: 11.5)
  misc_feature (332951)..(333010): NRPS/PKS Motif: NRPS-A_a3 (e-value: 2e-07, bit-score: 23.4)
  misc_feature (333383)..(333406): NRPS/PKS Motif: NRPS-A_a5 (e-value: 0.057, bit-score: 6.6)
  misc_feature (333518)..(333607): NRPS/PKS Motif: NRPS-A_a6 (e-value: 2.4e-12, bit-score: 39.0)
  misc_feature (333695)..(333760): NRPS/PKS Motif: NRPS-A_a8 (e-value: 1.3e-08, bit-score: 27.1)
  misc_feature (333749)..(333975): AMP-binding enzyme C-terminal domain
  misc_feature (334082)..(334251): Phosphopantetheine attachment site
  misc_feature (334397)..(334797): Polysaccharide biosynthesis protein
  misc_feature (334397)..(334986): NAD dependent epimerase/dehydratase family
  misc_feature (334400)..(335202): 3-beta hydroxysteroid dehydrogenase/isomeras
  misc_feature (334403)..(335115): Male sterility protein
  misc_feature (335668)..(337022): AMP-binding enzyme
  misc_feature (335848)..(335886): NRPS/PKS Motif: NRPS-A_a2 (e-value: 4.2, bit-score: 1.8)
  misc_feature (336124)..(336177): NRPS/PKS Motif: NRPS-A_a3 (e-value: 1.8e-06, bit-score: 20.5)
  misc_feature (336817)..(336888): NRPS/PKS Motif: NRPS-A_a6 (e-value: 8.2e-09, bit-score: 27.8)
  misc_feature (336991)..(337053): NRPS/PKS Motif: NRPS-A_a8 (e-value: 0.00044, bit-score: 13.1)
  misc_feature (337756)..(338600): Condensation domain
  misc_feature (337828)..(337905): NRPS/PKS Motif: C2_DCL_024-062 (e-value: 0.079, bit-score: 5.3)
  misc_feature (338113)..(338163): NRPS/PKS Motif: C3_LCL_132-143 (e-value: 0.0003, bit-score: 13.5)
  misc_feature (338512)..(338589): NRPS/PKS Motif: C5_LCL_267-296 (e-value: 7e-05, bit-score: 15.4)
  misc_feature (338683)..(338760): NRPS/PKS Motif: C67_LCL_14fromHMM (e-value: 0.00099, bit-score: 11.4)
  misc_feature (339124)..(340361): AMP-binding enzyme
  misc_feature (339313)..(339351): NRPS/PKS Motif: NRPS-A_a2 (e-value: 0.14, bit-score: 6.2)
  misc_feature (339556)..(339615): NRPS/PKS Motif: NRPS-A_a3 (e-value: 2.3e-11, bit-score: 35.3)
  misc_feature (339727)..(339759): NRPS/PKS Motif: NRPS-A_a2 (e-value: 16.0, bit-score: 0.0);"
  misc_feature (340168)..(340248): NRPS/PKS Motif: NRPS-A_a6 (e-value: 1.4e-10, bit-score: 33.4)
  misc_feature (340327)..(340392): NRPS/PKS Motif: NRPS-A_a8 (e-value: 2.6e-10, bit-score: 32.4)
  misc_feature (340381)..(340622): AMP-binding enzyme C-terminal domain
  misc_feature (340705)..(340895): Phosphopantetheine attachment site
  misc_feature (341021)..(341871): Dehydrogenase E1 component
  misc_feature (341306)..(341538): Thiamine pyrophosphate enzyme, C-terminal TP
  misc_feature (341339)..(341511): 1-deoxy-D-xylulose-5-phosphate synthase
  misc_feature (341372)..(341562): Transketolase, thiamine diphosphate binding
  misc_feature (341951)..(342474): Transketolase, pyrimidine binding domain
  misc_feature (342569)..(342900): Transketolase, C-terminal domain
  misc_feature (342984)..(343153): Biotin-requiring enzyme
  misc_feature (343509)..(344014): 2-oxoacid dehydrogenases acyltransferase (cata
  misc_feature (344111)..(344220): Thi4 family
  misc_feature (344120)..(345126): FAD binding domain
  misc_feature (344123)..(344217): FAD dependent oxidoreductase
  misc_feature (344123)..(344223): HI0933-like protein
  misc_feature (344123)..(344271): FAD binding domain
  misc_feature (345588)..(346200): O-methyltransferase
  misc_feature (345738)..(346059): Methyltransferase domain
  misc_feature (345747)..(346065): Methyltransferase domain
  misc_feature (345888)..(346107): Protein-L-isoaspartate(D-aspartate) O-methyl
  misc_feature (347303)..(349496): Penicillin amidase
  misc_feature (349785)..(350235): GatB domain
  misc_feature (350349)..(351210): GatB/GatE catalytic domain
  misc_feature (351298)..(352627): Amidase
  misc_feature (352764)..(352989): Glu-tRNAGln amidotransferase C subunit
  misc_feature (353347)..(354236): Putative modulator of DNA gyrase
  misc_feature (354871)..(355127): AAA domain
  misc_feature (354871)..(355220): AAA domain
  misc_feature (354871)..(355229): AAA domain
  misc_feature (354871)..(355343): Shikimate kinase
  misc_feature (354874)..(354959): Cytidylate kinase-like family
  misc_feature (355603)..(355711): Prokaryotic dksA/traR C4-type zinc finger
  misc_feature (355687)..(355900): Dynein heavy chain and region D6 of dynein moto
  misc_feature (356108)..(356342): Multidrug resistance efflux transporter
  misc_feature (356108)..(356486): EamA-like transporter family
  misc_feature (356531)..(356843): Multidrug resistance efflux transporter
  misc_feature (356537)..(356915): EamA-like transporter family
  misc_feature (357146)..(357603): 5'-3' exonuclease, N-terminal resolvase-like do
  misc_feature (358006)..(358709): Protein of unknown function (DUF2797)
  misc_feature (358366)..(358538): Protein of unknown function (DUF619)
  misc_feature (358787)..(359625): Protein of unknown function (DUF619)
  misc_feature (359648)..(360246): Fumarase C-terminus
  misc_feature (360586)..(361048): Methyltransferase domain
  misc_feature (360628)..(361024): ubiE/COQ5 methyltransferase family
  misc_feature (360655)..(361024): Putative S-adenosyl-L-methionine-dependent m
  misc_feature (360679)..(361015): Methyltransferase domain
  misc_feature (360709)..(361009): Methyltransferase domain
  misc_feature (360715)..(361000): Methyltransferase domain
  misc_feature (360724)..(361000): Methyltransferase domain
  misc_feature (360727)..(361003): Methyltransferase domain
  misc_feature (361218)..(362253): Family of unknown function (DUF490)
  misc_feature (363278)..(364295): Surface antigen
  misc_feature (365175)..(366767): FtsK/SpoIIIE family
  misc_feature (365176)..(365699): Domain of unknown function (DUF4117)
  misc_feature (366253)..(366410): Domain of unknown function DUF87
  misc_feature (366253)..(366410): Type IV secretion-system coupling protein DNA
  misc_feature (366280)..(366674): Type III restriction enzyme, res subunit
  misc_feature (366289)..(366413): AAA-like domain
  misc_feature (366292)..(366362): Type II/IV secretion system protein
  misc_feature (366298)..(366710): AAA domain
  misc_feature (366631)..(366845): AAA-like domain
  misc_feature (367235)..(367928): MutS domain V
  misc_feature (367943)..(368816): MutS domain III
  misc_feature (368066)..(368345): MutS family domain IV
  misc_feature (368858)..(369236): MutS domain II
  misc_feature (369260)..(369599): MutS domain I
  misc_feature (369753)..(370426): Periplasmic binding protein
  misc_feature (370862)..(371207): Biotin/lipoate A/B protein ligase family
  misc_feature (371932)..(372173): Surface antigen variable number repeat
  misc_feature (372184)..(372446): Surface antigen variable number repeat
  misc_feature (372454)..(372689): Surface antigen variable number repeat
  misc_feature (372697)..(372923): Surface antigen variable number repeat
  misc_feature (373000)..(374003): Surface antigen
  misc_feature (374107)..(374546): Outer membrane protein (OmpH-like)
  misc_feature (374838)..(375217): FabA-like domain
  misc_feature (375361)..(375958): Inhibitor of apoptosis-promoting Bax1
  misc_feature (376125)..(376524): Sodium/calcium exchanger protein
  misc_feature (376623)..(377007): Sodium/calcium exchanger protein
  misc_feature (377157)..(377418): Rhodanese-like domain
  misc_feature (377493)..(377748): MoeZ/MoeB domain
  misc_feature (377923)..(378163): ThiF family
  misc_feature (378025)..(378175): Shikimate / quinate 5-dehydrogenase
  misc_feature (378583)..(379117): Glycerol-3-phosphate acyltransferase
  misc_feature (379331)..(379779): FAD synthetase
  misc_feature (379826)..(380190): Riboflavin kinase
  misc_feature (380353)..(382181): tRNA synthetases class I (I, L, M and V)
  misc_feature (380440)..(380873): tRNA synthetases class I (M)
  misc_feature (380977)..(381350): Leucyl-tRNA synthetase, Domain 2
  misc_feature (381967)..(382208): tRNA synthetases class I (M)
  misc_feature (382015)..(382205): tRNA synthetases class I (C) catalytic domain
  misc_feature (382027)..(382238): tRNA synthetases class I (K)
  misc_feature (382312)..(382787): Anticodon-binding domain of tRNA
  misc_feature (382648)..(382835): Sin3 associated polypeptide p18 (SAP18)
  misc_feature (382945)..(383033): Zinc finger found in FPG and IleRS
  misc_feature (383193)..(383527): Signal peptidase (SPase) II
  misc_feature (383595)..(384315): Ribosomal RNA adenine dimethylase
  misc_feature (383955)..(384225): Methyltransferase domain
  misc_feature (384021)..(384237): Methyltransferase domain
  misc_feature (384039)..(384246): Putative methyltransferase
  misc_feature (384063)..(384258): DREV methyltransferase
  misc_feature (384087)..(384261): Methyltransferase domain
  misc_feature (384351)..(385221): Pyridoxal phosphate biosynthetic protein PdxA
  misc_feature (385468)..(385639): PPIC-type PPIASE domain
  misc_feature (385480)..(385609): PPIC-type PPIASE domain
  misc_feature (385486)..(385669): PPIC-type PPIASE domain
  misc_feature (385759)..(386029): PPIC-type PPIASE domain
  misc_feature (385762)..(386074): PPIC-type PPIASE domain
  misc_feature (385771)..(386059): PPIC-type PPIASE domain
  misc_feature (386167)..(386509): SurA N-terminal domain
  misc_feature (387320)..(387594): Tellurite resistance protein TerB
  misc_feature (387719)..(387906): DnaJ domain
  misc_feature (387955)..(388562): Ribulose-phosphate 3 epimerase family
  misc_feature (388420)..(388571): Histidine biosynthesis protein
  misc_feature (388720)..(388996): Domain of unknown function (DUF4282)
  misc_feature (389225)..(389639): Ubiquinone biosynthesis protein COQ7
  misc_feature (389228)..(389552): Ferritin-like domain
  misc_feature (389829)..(389991): Sigma-70, region 4
  misc_feature (390030)..(390261): Sigma-70 region 3
  misc_feature (390282)..(390498): Sigma-70 region 2
  misc_feature (390591)..(391026): Sigma-70, non-essential region
  misc_feature (391248)..(391350): Sigma-70 factor, region 1.2
  misc_feature (391386)..(391614): Sigma-70 factor, region 1.1
  misc_feature (391794)..(392199): DNA primase DnaG DnaB-binding
  misc_feature (392487)..(392634): Toprim-like
  misc_feature (393232)..(393454): CHC2 zinc finger
  misc_feature (393624)..(393792): Ribosomal protein S21
  misc_feature (394010)..(394800): Thymidylate synthase
  misc_feature (394812)..(395284): Dihydrofolate reductase
  misc_feature (395309)..(395456): Ribosomal protein L33
  misc_feature (395522)..(395708): Ribosomal L28 family
  misc_feature (395906)..(396273): Fe-S metabolism associated domain
  misc_feature (397620)..(397845): Aldehyde dehydrogenase family
  misc_feature (398927)..(399167): ATP synthase, Delta/Epsilon chain, beta-sandwi
  misc_feature (399213)..(399510): ATP synthase alpha/beta chain, C terminal doma
  misc_feature (399549)..(400194): ATP synthase alpha/beta family, nucleotide-bin
  misc_feature (400359)..(400557): ATP synthase alpha/beta family, beta-barrel do
  misc_feature (400638)..(401502): ATP synthase
  misc_feature (401619)..(401907): ATP synthase alpha/beta chain, C terminal doma
  misc_feature (401937)..(402624): ATP synthase alpha/beta family, nucleotide-bin
  misc_feature (402432)..(402624): KaiC
  misc_feature (402831)..(402993): ATP synthase alpha/beta family, beta-barrel do
  misc_feature (402858)..(402990): HAS barrel domain
  misc_feature (403099)..(403606): ATP synthase delta (OSCP) subunit
  misc_feature (403659)..(404007): Cor1/Xlr/Xmr conserved region
  misc_feature (403677)..(403932): HrpE/YscL/FliH and V-type ATPase subunit E
  misc_feature (403689)..(404034): ATP synthase B/B' CF(0)
  misc_feature (404215)..(404425): ATP synthase subunit C
  misc_feature (404529)..(405210): ATP synthase A chain
  misc_feature (405375)..(405669): ATP synthase I chain
  misc_feature (406008)..(406429): Alpha/beta hydrolase family
  misc_feature (406020)..(406270): Alpha/beta hydrolase family
  misc_feature (406029)..(406204): X-Pro dipeptidyl-peptidase (S15 family)
  misc_feature (406080)..(406240): Lipase (class 3)
  misc_feature (406095)..(406354): Phospholipase/Carboxylesterase
  misc_feature (406511)..(407529): AFG1-like ATPase
  misc_feature (407568)..(407725): Isopentenyl transferase
  misc_feature (407661)..(408421): IPP transferase
  misc_feature (408682)..(408869): Preprotein translocase subunit
  misc_feature (408982)..(409262): SecD export protein N-terminal TM region
  misc_feature (409297)..(409382): SecD/SecF GG Motif
  misc_feature (410236)..(410741): Protein export membrane protein
  misc_feature (410317)..(410726): MMPL family
  misc_feature (410901)..(410950): SecD/SecF GG Motif
  misc_feature (411150)..(411712): Protein export membrane protein
  misc_feature (411832)..(412148): Seryl-tRNA synthetase N-terminal domain
  misc_feature (412345)..(412862): tRNA synthetase class II core domain (G, H, P,
  misc_feature (413148)..(413413): short chain dehydrogenase
  misc_feature (413160)..(413884): Enoyl-(Acyl carrier protein) reductase
  misc_feature (414052)..(414392): Biotin/lipoate A/B protein ligase family
  misc_feature (415262)..(416177): Ornithine cyclodeaminase/mu-crystallin famil
  misc_feature (416916)..(417450): Dephospho-CoA kinase
  misc_feature (417195)..(417447): AAA domain
  misc_feature (417617)..(418386): Ketopantoate hydroxymethyltransferase
  misc_feature (417629)..(417954): Phosphoenolpyruvate phosphomutase
  misc_feature (418444)..(419045): Pantoate-beta-alanine ligase
  misc_feature (419552)..(419739): ADP-ribosylation factor family
  misc_feature (419573)..(419772): Ferrous iron transport protein B
  misc_feature (419576)..(419739): Ras family
  misc_feature (419576)..(419742): Miro-like protein
  misc_feature (419576)..(419745): Protein of unknown function, DUF258
  misc_feature (419576)..(419799): AIG1 family
  misc_feature (419576)..(419811): AAA domain
  misc_feature (419576)..(419943): 50S ribosome-binding GTPase
  misc_feature (419579)..(419715): Dynamin family
  misc_feature (420124)..(421418): Amino acid permease
  misc_feature (420166)..(421460): Amino acid permease
  misc_feature (421520)..(422084): ABC-2 family transporter protein
  misc_feature (421601)..(422231): ABC-2 type transporter
  misc_feature (422574)..(423093): RecF/RecN/SMC N terminal domain
  misc_feature (422598)..(422817): AAA domain
  misc_feature (422688)..(423126): ABC transporter
  misc_feature (423006)..(423096): P-loop containing region of AAA domain
  misc_feature (423616)..(424318): Putative S-adenosyl-L-methionine-dependent m
  misc_feature (424493)..(424832): Dihydroneopterin aldolase
  misc_feature (425077)..(425231): BolA-like protein
  misc_feature (425496)..(425932): Acetyl co-enzyme A carboxylase carboxyltransf
  misc_feature (425772)..(426253): Carboxyl transferase domain
  misc_feature (426524)..(426627): Phosphoadenosine phosphosulfate reductase famil
  misc_feature (426524)..(426654): Asparagine synthase
  misc_feature (426524)..(427050): PP-loop family
  misc_feature (426527)..(426687): Queuosine biosynthesis protein QueC
  misc_feature (427193)..(427398): TilS substrate binding domain
  misc_feature (427586)..(427704): TilS substrate C-terminal domain
caagtgtaattaatttgaatttcacgatttctctcccttatcgtttaaacaataatataattcaaaaaataattcttttatataaagatttatttaactatagattagttaaagttaagttatcataatattttgtaatattcaaaatccatagttataattttttaattattgaatatagaaaaaaaataaaatgaattatattccaattcctatgaaaaaaattggaccagtaaaaattattggaaaagaatttaacatagaagtactagttcctttggcaacttttgaaacaacaatatatgcatcagcccaaagaggagcgcgtgcaacatataatgccggaggaattaattgtattttaatatatgactcaatgtcaagatctatatgcatggaagctaaaaatgctatgtctgctatacaaataaaatatgaaattgaaaaatcttacaatataattagtatgattatatcaagtacaagttcatttgcttccttagaaagtatgcaaattaaacaaataggttcaattttgtatattcgtatcaatataaaaacaggaaatgcttctgggcataatatggtcacaaaagctgccgatgctcttattatatggttgcttgaaaagtattctaaattaaaatatatatcagtttctggaaacttttgtactgataaaaaagtatcagcagtaaatcctttatttggaagaggtaaatctgtaattgcagatattattattccagatattttatgtcaaaaaattttacgtactaatgcaaaaaaaattgtagatctcaatattaaaaaaaatttattaggaagtattcaggccggaagcttgttgacggctaatgcccattatgcaaatttattgcttgctacttatcttgcaactggacaagatgctgcaaatattgttgaaggatcgcaaggaattacttatgctaaatgtgataaaaaaaatttatatttttcagtaaatatacctaatattatagttggcactgtaggtcatggaaaagatcatagttttataaaaaaaaatttgttggaattaggatgtttagaaaaaaatcattcttatttaaatagtagaaaattagctataattatagcagctactgtgctttgtggagaattatctttattagcatcacttaccaatataggtgaattaatgaaagcacatcaattttttgaaaggagaaataaatgaaaataggtattgaggacattaaattttacattcctgcattttatatttctttaaaaaatttagcaaaaaaacgaaatgttaatgttaaaaagtatttagttggattggggcaagaaaaaatgtcagtagtaccgcctgatgaaaatatagtttctatggcagccaacgccgcaagttatattgtaaataataaaaataaaaaatcaattggaatggtattgtttgccacagagagtggaattgatcaatctaaatctgcaggaatttatgttcatagtttgttagatttgcccaaaaactgtcgtattttagaacttaaacaagcttgttatagtgcaactggaggattgcaaatatcatatacttggctattgcaaaaccctcaaaaaagagttttaattcttgcttcagatattgctcgatatggtttgggatctccaggagaatcttcacaaggagctggagcggttgcgattttacttagtaataatcctaatattgcaagtattgaatcaggaagtggaatatatactagtaatattatggatttttggaaaccaaattattttgatgaagcattggtagaaggaaaatattcctgtaaaatgtatctaaaagctttaggagaatcttggaaagattatgtaaataatacaaaaagaatgtatcaagatcatgatcaatttatttatcatattccttttcctaaaatggctaataaagcccataaatatttacaagaatatgtaggattaaattcatccaatttaaataatgttagtttaaaattgaaagattctttaatatatagcaaacaaataggaaattgctattctgcttcattatatttaggattaatatctttattggataattctgttaatttatcaaatcaaagaattggttgttatagttatggttctggttgtgttgcagaatatttcagtttaagagtttctagaaaatataaaaaatatttatctattctattaaataaaaatcttttaaaaaaaagaaatgaattagatattaaagaatatgaaaaatattatttataccattctagaaaaaacaattctccaaatagaatatttcctaaaattactcaaggaagatttcgattttttggaataaaagatcataaacatatttatggagaataaagaaaataatgaaaaaaaaaaaaaataatatttgtcgcatgtctgttccagggaaaattatccttacaggagaacatgctgttttatatggtggtcctgctcttattgtaacgataaatcttttttgtaatgttctgatatgttcagaaccagaaaaaataaaattagagtttttagatattaattattttaatacttgcacgttttatgaattacaaaaaattcaaattaagcttaaaaatttacaaagtgacttttttaagaaaaaaactaatattagtttacaagatttcgaaattatacaatatagcatttatagaattttaaaaaaattaaagtttaattttacttctggtttgaaaatcatgataaaatcagatattcctattggttgtggcatgggatcatctgccgctagtattattggtgttaactatgctatcatgaaatattttcaaaattatatagatgatatttcacaatttttattagctttagaaatagaaaatatacaacatgggaaaagtagtggtattgatttatataccataataaatggagggtgttattggttttctaattatataaataagaaatataaattaattatagataaattattgattattaatacgggaaaacccattagtattacgcgtgattgtgttttatcatgtaaaaaattttttctatcagataaaaatttaattaaaaaattttctgtaattgcaaaaactattaaaaattctttattatcatatgataaaagctcgcttatttgttctgtaaaatataatcacagattactagtatctattggtgttgtacctcataaaattcaaaatttaataaatcatatagaagaagcaggaggtgctgcaaaaatttgtggagcaggaagtatttctggggaaaaaggtggtattatttggatagtaggagaaaaaaaaatattaactcctgttgtaagaaaccagggatataagattaaggaaatccatattacatatgaaggagtttattattaaaaaatataaaaatgcaaaaataaaatgatttttcatgcttctgcaccaggaagtttaatgattatgggagaacatgctgtattacataatcatccttgtttaattactagcatctcttccagaatacatgtaaaattaaaacccagaaatgataaaatagtatctattacttctattttgggaaaatggaaaggaatattaaagaattttcctcaaaaatgtcaatatcagtttatagtaaaaactatagaatattttaatccaaataatggatttgatttatttattacaaatgaatttcaatctaatattggattaggttcatctactgctgttgttgtttccatgttctttgtatttaatgaatggatgaaaacgaattttcataaacaaaaaattttattatgttgtataaaagtaattcaatctatacaaaaaggaataggatcaggagctgatgttgctgcaagtatatatggaggattaataatatatcgaaaaattgattcatttttaaaatcaactattattataagatctttatcttttaaattaccgtattctatttttgttatatatagtgggagaaaaatatcaacttttgatgttgttcaatatatagaaaaaaaaatttgtcccaaaaaaaaattttttttatatcggaaaattggaaaattagttaaaaaaatggaaatttatctttctaaaaaagataataataaaatatttaataatattattacatcacacagaaaaatacaaaaacaacttaatttacatacacctcaaattaattggatatttaaaaaacttaaagataataaaaaaatatattgttttaaaatttctggtgctggtttaggtgactgtatcataggttttggtaaatgttcaaaaaaattatttaaatataaatatgcattaaaaaattgtatttttttaattcctatacaaataggtcaaatgtcagatggagcaaaaatacatatataaacatcctatttattctatattaaaagatccaggttatccaatcatggaaactgctactgcatttgcacctactaatattgctttaattaaatattggggtaaaagaaattcattttataatttaccttttactagtagtatatcgatttctctaagaaataaaggaacgttgactacaatttcattatctaatgatggaaaggataaatattacttagataaaaaatttatgcataaagaacatcctttttcacaaagaatatttaaatttttaaatggaatacgtcctaaaaaattaggatttataatccatactcaaaataattttccttccaatgtaggtttggcttcatctgcttctggtttttgtgcattagttttagcattaaataaattgtttaattggaaaatgtcatatattgatttatctcgtttatcacgcattggaagtggtagtgcatgtcgatcgttatggaatggttttgttaaatggcaatctggcaaagattttcaaggtaaagattcttatggaattcaattaaatatatcttggaaagaatttagaattggcattccttttataaataagaaaaaaaaaattatatcttctagaataggaatgaatcatacagtcaaaacatcaaaggatttttttttatggataaaatatacaaaaaaatatcttcgtatttttgaaaaatcactttatgaaaaaaattttcaaaatataggttatataacggaatcacattctttatatatgcatactatcattgaaaattcaattcctccaatttattatagaacaattgaaacattaaaaattcaaaaaaaagtttataatttgcggaaaaatggaatttctgttttttttacacaagatgctggtcctaatattatattaatttttttaaatgatatagaaaaaattattcaaaaaaaatttccaggaatcaatataattaatcctttttgataaaaaggattttttataaaaaaattaatttttattaatattaaatatatattataatttatattcaaaaaataaactttatttttaaatgaaaaatattaatcattctatagaatttattactttatgtaagtctgcaaaaaaaaaaataaaagaaatatctactgatgaagtttataaaaaaaataaaaataatcatacattgtatttatttgatgttcgtgattattatgaatataattctggacatatatgtaatgcacaatttttaagcaaaggatggatagaagcgaaaattcataattttgtttctaataaattttcttttataatattatattgtggcagtggaaaccgatctgcgttagctgcagaaaacttacaaaaaatgggatatattaatgttttttcaatgaaaggaggaattaaatcttggattcaagaaggaaaacccattataatatgaaaatattataatgccattctaaaatagattaatatctatttaataaaatcaaaaaaatattttttaaaataaatatttataatctttaatccttcttctatatattgattgaaatatgtgcttttccaaatttctgatttagaaatgccaaataattgaataaaatatgttagaattattattaatatcatacctcgaataattccaataattattcctaaaattttatttataatagattcttctgaagaaataaataaaattttaaaacaatatatcaatatacttgctactataaatactataaaaaaactaataatatagcatatatatattgacagtttcgtattataaattgtatgagacacatgtatagaaaattgatatcctagataaatagtacctattattatcaatgtccattttataaatgaaatgatttcttttaaaaaacctcgataaaatcctacaaaagaagaaaaacaaataattaaaatgaatatttcatcaatccaattaaaatttttaattatttctattatattcattatatttaatataattattaatatattacatattaaatattttaatataaaaacctttacgaagataaataattttcattaaaattattaaatgtgtatttttttaaaaaataataaagattcttttattactcgaaaagaaccaaagattattaataaatcattagatttaagagaataaattaaatattgacacgcagatatgacagatttatgttgaaatgattttttaaataatgcagattgcatgtctttaatagaggccgcacgtttttcgttttgtaagaaagtaaaatgccattccgcttgtaatgaatctaatattctaatcatttctttatatttcttgtctttaagagaagaaaaaagacatattatttttttatcataaaattttttttgtataaaatatttaagatatttcgttgattgtatattatgtgcaacatctaaaatgatttttttatcataaaaatttaaaatttgcatacgacctataacattaaaattttttaaaatttttattaacacattatgagataaaatgtttatattataaaattcttgcaatatttctaataccattaatgcagtagatgcattttgcaaaggaatatttggaataggtaatttattaaaaaaattttttttactattccaataccaataaaaaaaattttctttaaaattaaaatctttattttggattaataatggcatatttagttttttagcatatagaattacagatttaggtggttttggatcgccacaaattcctatagaatttgtacgaaaaattccagctttcattaatccaattttatttcttgtgtttcctaatatttcttgatgatcaaaatcaattgttgtaataacagaaattatcggatttaaaatattagtagcatcaaataaacctcctaatccaacttcaaggagaataatattaggcttttttaatttaaaaaattttaaagttattaaaaatataaattcaaaatatgttacattggaattgattttttttaaatcagtttttatatattcaataatatttattaaatctatatctgatggatgatatgaatcaactactatttgttcatttattttgaatatacaaggtgaaataaacattccaactttatattgataatataataaaaaacgataaattaaatttattgtagtgccctttccattggtaccagctatagttattataggaatatttgaaatatttaattttaattttttaacaatttttttaaatgataaaaaatcattatgcgttatatttatattctttttaataaatccatttgttaaatttaaaaattttttaggagacataatttattggtattttttgcaattttctaattaatgatgtaatttcatcgcgtaatttatatcgtggaactatcatatctatcatgcctttatcttgaagaaattcacttttttgaaaatcttttggtaatttttcacgaacagtttgttctatgactctttgtccagcaaatccgattaaggcttgtggttcggctatatgaatatctccaagcatacctaaactagcagacacaccgcctgttgtaggatctgttaatacaacaatatatggtatagaatattgttttaatatttttatagctgcagaaacttttaccatctgcattaatgcaaataccgattcttgcatacgaacccctccactagcagtaaaacatattaaaggtatttttttttttattgcaatatcaattgcttgaacaaaatattttcctactagagtacccattgatcctcctagaaattcaaattcaaaaacagccattactatggataaaccattaattttccctttaatcactattaaagcatctttttcattggtttttttttgtgctgataataaacgatctttatataatatagtatctttaaattttaatttatctaaatcttcaatattaggaaaattatttttattgatttctttttggccgtctttatctaaaaaaaacgatatacgatctcttgcagaaattcgaaagtggtattcacatgtagtacatacatataaatttttttctagttctggaatatataaagtttcagaacaagaaggacatttttcccatataccctcttttactcctttctttttttttaatatttctgtacgaattcgtgaaggtaaaatatttttaaaccagctcataaaaatcctccattgtaaaatttgaaagtttaggaaaattatatttatcaggataatttactgatattaaatataatcctgcaggaggtgcagttattccagcatattttctatttttttttttaagcactattttcatccattctattggtttttttttttgaccaattattagcaaagttcccacaatattacgaaccatatgatgcaaaaaagaatttgcagaaatatcaattccgatgatcttttttttttgccaaatatttatataatttatttttctaatacttgttttagattggcattgagaacttctaaacgaggaaaaatctttttcacctattaggcatttagaagaatcattcatcaactttctatccaattcataaggataatgcgtaatttttccaaaaaaaattggcaacataactttgttttgatcaattaaatatcgatattgtctagaaattgctgcaaatctagcattataatttctttctgcatatcttgcccaaataactcttatatcttttggtaagtatctattagttcctaatatccatgattttaaagaacgatttgcaaaactaaaaaaattaattacttgtccaatagcatgaactcctctatctgttcttccagcacaaaaagtattaattttatgattggccactttatttaaagataattcaatatgatattgaataaaatatttcttattttttccttgccatccataataatttgtacctttataagaaattcctaatacaatattattcatctatatacaaaataattttttttaaaaacctcttaaataagattttatactatttttttgatagaaactataacaaaattgatattttttaattataaaattattttgtatagatatatttttaatattatttattctatcttttatagaaaaatactattgttataatgcaatatatatgctataaaatatattatattgaaattttgaaagtttttcttttgaaaaaaataattattggaattactggtgcatctggaattatttatagtcagcgtcttttagaaattcttttttcaaatcctacaattgaaactcatttaattgtttcaaaatcctcagaacaaatacgccatacagaaatagataaaacttctttagaattaaaaaaactagctaattatcattataatgtaaataatatttctgcactaattgctagtggttcttttcgaacaaatggaatgattattattccttgttctatgaacacattaggagaaatagcaaatggaatttcaagaaatttaattactcgtgctgctgatgttgttcttaaagaaaaaagaaaacttattttagttactagagaaacacctttgcatattaaacatttagaaaatatggtacaagcaactaaaataggtgctattatttctcctccaattcctgcattctataataagcctgaatctattaaagatcttatagattatacaattgttcgaatattagatttatttaatattaaagttaattttttggtaaaacgatggggatcaatttattaattatattttctattatagaataataacttaattttgatatttttttatttacagcaattgcgccaaaataaaatttttctggagaaaaaaaatacaatttccattgagaataaggaaatttttttttataaatttttagcaatccaggtttattattacaactaactaaaaattgatttaagccaaattgcaatcctacaccttctgcttttacaaaagcttccttttgaacccatatttgaaaaaataactttctttgttttttaaaaggtaaatcaagaagatgaaaatattcttcttttgtaaaaaagaaatgagccaatgataaataatttttataagtttctttttcaatatctacacctaattcataattataacctattccaataacgaaccattctgaagaatgactaatattaaatttaatattagaaatatgatcaatataaggttttccgttttttccatttttaatattaatatttgaaatatcgcaattagtataaaaagctaataatatttttagtattcctcttgctataatgtaattgcttcttaaataattaaatttataacgaaatgctcgaacaatttcttcttttgataaaaatttttctaataatttttgaaaattatgaaattttttaaattttgctttccataatataaccatattagattttaatttaggaatataagaaacgctcttccaataaatatctgaattaatttataaaaactcccatttaaattttatacaaaaaatataatgaatttttaatattttcgaatatgatctattattttttgaaaatttttattttttggtacttttccttgaattatccaattccataaatattgatcatgatatgataacattttttgaaagtctttttttcttttttctgaacttataaaataaaaattttttatgtaatattgtaatagtatatctaattctaacattcctcttctagaggaccataatatttttgaaatattcatgaaactaaattagtaaaaatattatctaatattaattcattgtataatatatatttaattaaaaatcaaggagatatctaatgaataaaataatttggtataatttattagaatatggatatatcgaaatatatggcaaagaatataattcttttttacaaagtcaattaacatgtgatataagaaagataaaaaaaaatgaatgtattatctcttctcattgcaatagaaaaggacgtattataagtttgttttggatacataaaatagataattctgttagattgataatgcctaatgatgttattgatattgcgttagaacatttaaaaaaatattcttttttttctaaaatttattttagaattaaaaaattttcttatttaggaataaaaataaaaaaaaattatgtatttccttcatctttttttaaaaaaaaaattgttaaaatttttgaaaataaatatttatattgcatctcaaaaaatgaaaaaataaactttgaagagttatcttctattaatatttgggaacaatattttataaaaaaatatcatttttttttatttccagaaactattggaaaattattacctaacaatactaatcttgaaaaattaaaaggtctatctttcaataaaggatgttttataggacaagaaattatagctcgtacacattttttaggaaaaaatacaaaaaaattgatattattacattcgtctgggaaacccaaaattttggaaaatattaaaaatgaaaaaaaccaagattgtggaaaaattatttttttttctaaaaaattaaataaaaaacaattttgtttagctattatcaaaaatgtttcttatcaagaaaataaaatattaactactgaaatatctaaacatactgtaataattaaaaaataatttttttatattttaagaaatttaattttttttttgaaaagatttaattttttcatttgctttttgcaattgatttctatagaattttaagtctttttctgatatttcttttattttttttatttctttttcaagagaaaaaatagtttcctgggtaattctttgtatttcattaattctttttgaaacttgttctttaataatatctgaataatatttagcatcatttgtcattttctttgctacttctctacgaattttttctttataaagaagagattttaaattagatatttgttgtaataattcattattattcattttttctaaacgttctgtagttaagtttttataatattcttcttctattattgaatgttctataatacttttattttttttctcacgtttattattttgataaattctttttgtattttttttattttttccattttccttttttatttctttatttttttcttcttgaagaagaaaattttcttttttttcaattacttttttattcatatttaatattcttcataaatgtattatttttatataaaataatattttttctgtaatatattattttttaaattaagtttttaacaaattttatattttattaaaataagaaaatttttatttaaaattttcataaaacaatataatcttcttttgaagaagaaaatatatgtctttctttaaaaagaaaaaaatatatttaatgaaaatatttattattaataatagtttatttttaatattgtattataaaagattttccattatattgtataatcttaacttgcacattccatatatcataaatgtttttaacattcagtatatttttgggatctccttctttaattatttttccaaatttcattaactttacatgatttgtataatgtaacgcaatatttagatcatgtaataccaaaattattcctagagaatcgcttaatatattctttaacattcgaaatattaaaatttgtacattcatatccagatatgttgtgggttcatctaaaaataaaaattgagtacgtttagtatagcctaattgtaattgaaataaaagacgagcaaaatgtataagttgtttttctcctcctgataattgattataataattatttaataatttttcaatatttagcatattagaaattatctttattaaagataaattgcgttgattttttttccaagcatatcctcccattaaaataatatccttgacaacaagattagaactcatactcaaattttgagaaagaaatgcaaaatgtcttgcttttttttgatacgaccaattttcaatattattattatttaatgttattaaaccatttgatataggcattccagaagaagattgtaataaagtacttttccctgcaccattcggtccaagaatagctgtaattttattaacttcaaattttgttgatattaaaaataattttcctaaatgttttgtactaacatttgaaagtattaacataactaaatttccttattataacgaaacattataaaaagaaaaattggtaccccatataaagatataataatacccaatggtaaataaaaatttttaaaaaaagaacgagaaatattatctgttaataataataaagaagaacctgctaacccactatgccatattaattttttatgcaaagaacctgaaataatgcgcataatatgtggtacaattaacccaataaaaactattgggcctattaaagatacagatgcagacatagataaagctatgcctatcatggcatttcttttaagtttataaatatctactccagaataaattgcatctatttcacctaatattaataaatcaagttttgaagattgagatgttaagataataaaagagattacagtcattaatccagaaatacctaataagtgccaatttttttggattattccacccatattccaaataaataattcttgtaattgcatattagttagttgcagtataaaaatgctactgcatgcagaaattcccatatttaatattatgcctaataataataatttagatatattaaataaagatatatacttagataagtaaaataataataatatagataacatgcctcctattaaagaggataatggcatccataaagaaaattcccataaacttccagcacctaaaatccagcatattacaataaaaaattgagatccactagaaactcctaataatgaaggatcagaaagtggattacgaaataatccttgcatgacacttcctgaaatacttaaagaaaaacctgatatcaatattgccaatgtatgtggtatgcgcaatttccatataatttgatataataaatgattgttaaatttatgaaaaaatagtatatgtataatatcataccaagaaataactattttcccgacttttatattatataatgcaagaaaaattggcaacaaaactatacatttagattttatatatttatacttagttagcatttctttatttaaaataatatgaagcaagattatcaattaaaaaataaacggatagttgattactctgataaaaaaaaattttataaaaatttaagaaataattataaatctcaaattaagataagatggattcttatttttgtattaataataataattatatttattttaatttattttaatctattttcaataaaatttttattatttcaatttatagatagtttttataagaatcaagaaatttgtattcctttgaagttatagaagtatttaataaaataattataattttaaaaaaatacaattaaattaatttattagataataaaatgaaaaaaaaatttcaaataaaaggaggattatttactcttagtgtattacaattacattctattgatttcattttgttaaatgaagtattagaagcaaaaaaaaatataaatcctaattattttaaattagctattccaattgttattgatgtaaaaaacttaaatattgaaaatatatataatcttaattttaaaaagctaaaagaagtactttttttatataaaatttatcctgtaggatttaaagggatttctgaaagatatatacaaaaatatattcaaaatcatggatatcctatacttaatagcaaccaatatttttctttagaaaagaaaaaatattatcaaaaaaatagtttaattattacagatcctgttagatctggacaacaaatatatgcaaaaaatcgagatttaattattactaataatgttagtcctggatctgaattattttcagatgggcatattcatgtatatggaaccctaaaaggaagagctttagccggaattaatggaaatacatctgctcgtatattctgcaataaattagaagctgaattagtttctatttctggacattataaaatttttgaaaattctcataattttcgtactattaaattaatacaattttatttaaaaaatggaaaactcattatgagtagtttaaaataatatatcaagattatttttttattctaaaatagatttatctttaatgtgaattccataatcagacaatatatttctaattttatctgcatttttccaatctttattttttcgagctatttcacgttttttaattaaactttgaatattttcatcaagtatattttttgtagattttaaatattttttcggattttcttgtaatattcctaatatagatcctaaatatttcagttcatatgcatactttgacgctaatgaaaaatttgtcttttttaaagattttatttttttagcacatttaaataatataaaaatagctttaggtgtattaaaatcatcattcatactatcaataaattgcttagtataagaagattggaaatgtatctttttaggaaaatacatattttgtaaagcagaatataattttattaaagaaaattttgcagacaataattttttttcatcgtatgaaatattttttctataatgcgatagaaaaaaaaaatatcgtatcacctcagaggggtattttgatcgaatattatgaatcgtacaaatatttcctaatgatttagacattttttgatttttgtaacgtaccattcctgtatgcatccaataatttgctatttttgatgtatatacagattcaaattgcgctatttcattttcatgatgaggaaaacataaatcttttccaccaccatggatatcgcactttttttctaaatatctattgaccataacagaacattcaatatgccaacctggtcttccatacccccagggggacatccaaccaatacattgatcttctgaaactgatttccaaactgcaaaatctaaaggattttctttttcttgatcttggttaatttcattatctatttttaattcattaatattttgtccgcttaattttccataaccaggaaaagaggaaacacgaaaataaatattattatttttgctaatatatgcatttctattttttaataaaatatttatcatatttataatatgatcaatattttctgtgacacgaggttcttgatttggttttaacattcctaaatctaaaaattctttgttcataattttaataaaacgagatgttaaattaaaaatattttctttatttttttttgcatgatagataattttatcatcaatatctgttatatttcgaatatagtatattttatatcctcgccattttaaaaagcgaatgatcatatcaaaaattaaatatgttctagcgtgaccaatatgacaataatcataaacagttacaccacatacataaaaaaaaattcttttttcttgcaaaggataaaaaatttcttttttttttgtaaaagtattataaatttgaagcatataatttatattctatgataagaaaaatatttttatttaaaattttaatgaattataaataaataaaaacatattaaactaaatctagttaaattaaatattaaataatatatttaagaatttaaaaaatctatttcttttttagttaaattacgactttcttcttgtaagagaataggaatttcttcacgaataggaaaagaaatgtaatcttttttgcaccaaagttcttgtatatttttctgaaaaaacaatttttccttacataaaggacatactaatatatttaataattttttcaatttattatttccaataaattccaaattatatcatggatataattcagtttgaataaattctattatttagaataaattttttaaatcatttttatacaacataaatattccttgtcccccgcaatataaagtcaaccatataaatggtatattaggatacattttcattatttttttttgatgatcccctacttcaactaacaaaattccattttcagataaatattttttagatttcatgagaatttcttttatataaaataatccgcccatttttgcttttaaagatataatcggctcataagaatattctttaggaagtttatgaagttttttttcgtctatatatggaggatttgcgaaaattatatcaaaattattttgataaatatttttaaaaatatcagattgaataaaatttatttttttttctaaagaataatgtctagcatttttttttgcaatttttaatgctgaaaaactaatatctgaagcaaaaatttttaaatgtggataataataggctaatgcaatagcaatacaacctgatcctgtaaatatatctaaaataaatttggcattttctattttaatccaaggtaataatttatttttaattatttctgcaaatggagatcttggtataataacatttttattaatataaaattttataccagcaaaatatgattcatataataaatatgacaatggtatcttatatgtaagtcgattatctaaaattgttctaatttttcttaataaatttttttgaatttttttatttaaaattttttttatatttaaattttctctttttacaatagcagaaactaaccaatttgcctcatcccaagcattatttgttccatgtccgtaataagaagaagatttttttaatctataaaaaacatcaaataaaacttcttttactaacatataattttcatataaattactatatgtcctataaataatataaaaaatttttttatgatatcaaaatataaatatatataaactaaaataattttaaaaaaataaataatcaagctagaatagcattttctagattttttaatgcataaatataagatgcagttcgcatatctatattttttttaatagaaatattattaacagaatcaaatgcatttttttggtattgatataatttattatatacagaatcaagattccaatattctccagttttattttgaatccattcaaaataactcactattactccacctatatttgctaaaatatctggaattattgttattttcttatgtttaagaatttcatctgcttttgctgttattggtccattagctacttcaataatatattttgcttgaattttatgggcatttttagtagtaatttgattttccatagcagatggaataagaaaatctactggcaaggataaaagtttttcatttgtgattttttgagattcaatatattgaaaagaatcttttttatgaatggaagataatgatttttcttgattttttctaaaaatccaacttgggatatctaatccatcttcagaaaagatagcagtactagaatcgcttattgcgattattttatacccatcaatatgtaataattgagcaatattttgggcagcgttaccaaatccttgtatagcaatttttattttatttgggctccatttatgtataaattccaattcttttaaacaaatataagcacctcttcctgtagcttctgttcttcctaatgtacctcctatatatataggtttccctgttattacacttggaatttttttttgatgtataacattatattcgtccatcatccatcccataatcttttcatttgtatacatatcaggagctggtatgtctgtattaggtccaataaattttgcaatttttcttatgtaacctctacttaatttttctaattctgttttcgataaagattttgaattcacacatattccgcctttagcacccccaaaagggatattagcaacagaacattttaaagtcatccaaaatgcaagagacataacttcatctaatgaaacatttaaatgatatcgtattccaccttttgttgggcctcgagaattattatgttgaactcttattccttgatatatatttaattttccattatccattctaacaggtattgaaaatttcaatacagaatccatatgttctaaacgatataaaacttctgaatctattttactataatttgttgcatgatttatgaattttttaatattttgaaataatttattacacactataatactcctacttaatttatcttgaatttaatagttcatagaataaaattgttagattactaaaaaaaatatgttctttgtttatgtcaactaataataaaaataaacccattgtaacaaaatacattataaaatcatacgaaaaaattattttttgcaggtgttggaaatctaaaaaatttcctttttgtgatggaagtcatagaaaagatacaattaaagaaaataaaaatattgataatatgggtcctattataatttatggagaaaaatgtatataattttagatttatattttataagtatttatttatagaaataataaattgatattttattatttttttttataatttattatgcagataataacattattgtatatgcctaaaataacatatttaaaagattatcaattgccaaactataagattaatacaattaaattactttttatatttgaatctataaatgtaaaaattataaatttaatggatattgaatctattaatgaaaaatgtacttcattacttttagatggagaaaaacaagaattagttaatatagctataaacaataggattttgaattcaaatgaatttttattaacaaataattcattaaaaatttttcaagtacctaaaaggtttcaacttaaaattataactatttgccaacctcatttaaacacaaaactagtaggattatataagtctgatagtatttattgcacacaatgcgaacctaatggttttcgaaaaattacttatttcatagatcgtcctgatattttatctatatttacagtaaaaattattgctgataggattgaaaatcctattttactttctaatggaaattgtattgattatggttatttaaataataatagacactatataaaatggcatgatccttatcctaaaccaagttatttatttgcattagttgtcggaaaattagatgtaaaaagagattttttcacaacttcatcagggaaaatagttaatatagaattatattcttctgtagaaaatattaataaagtagattttgctatttcagtattaaaatcttctatgaagtgggatgaaataaattatggtcgtgaatatgatttaaatgtttatatgatagttgcaatttcaaattttaatatgggtgctatggaaaacaaaggattaaatatttttaatacacaatatatattggcagatcctgaaatatctacagatcaagattatcaaaatattacttctattattggacacgaatattttcataattggacagggaatagagtaacatgtagagattggtttcaattgactttaaaagaaggattaacagtttttcgagaacaatgttttatggaagatcaattttcttgtaatacaagaatagaagatattaacactattcgttccttgcaatttttagaagattcaagtcctattgcacattctatacaaccaaattcttatcaagaaattaataatttttatactattacaatttataataaaggagcagaaatcgtacgaatgctttataccctagtagggaaattaaattttagaaaaagtatggatacatattttttactttatgataaaaaagctataacatgtgatgattttattaatgtaatatctaaatctaataacattgatttaacaaaatttaaattatggtattcccaaattggaactccttttgtttatataaaaaaaaaatattatgataaaaggaaaaaaatatacacaattatattggtacaaaaatatttcaataatttgtcaaaaaaacctttagtaataccaattaaatttgctttatttggattaaatgggaaacaaataaaaattcaatataaagaaaaatataattttgaacatattttaattcttaataaaaaagaacaaatatttacttttaatcaagtaatagattttccagtaccttcaatattaagaggattttctgcgccaataaaaattaatacaaaacagaatattaaagaattaatatttttaattaagtatgacaatgacaaatttaataaatggaattcagcacaaattatttttaaaaaaaatatatatttcataatgaaaaacattaaaaataaaaaaaaaaaaataaaatcaaacacatatttttttcaagaaatgaaaaatatttttaattcaaatttagatccatcatttattgctgaaatgtttacattacctaaaaaaaatattttttttgaagaaaataattctattgatattgatatattagaagaatcttatgattttttttctcaaaacattgcaaaatattttgaagatttttttttaaaaaaataccaatctattatagatatagataatactattacacctacaaacataggtaaaagaaaacttaaaaatatctgtttatactatttgtgtttattaaaatcaaaatatattactgatttagctatacaacaatacaaaaaaaataatatgaccaataaaatttttgcattatctatcataattaataatgctaattcttctttaagaaagaaaatagtaagtcatttttatttaaaatataaatataatccattattaatgaataaatggttatatttacaagcaacaggaaggtatcaaaatgtatttaaagatatacaaaaattattaaaaaatcctatttataatgatagaaaccctaataatattaattccttattgaagggatttactaaaaatttaaaagaatttcataaccccaatgggcaaggttatatttttatttctgataatataatacatattgataaatataatccccaaatttctgcagatttggttcaatctttaatacattggaaaaattttgatattcgaagaaaatatttaatgaaaaaagaattatttcgtatatacagaactcaaaatatttcttcaaatcttaaagagattattgataaatctaatatttaattatttaatatttttttttaaaaaggaatatcatcttcttcaaaattctttttagaatcttttaaagtttctatatttttatttaaaaaagaattatgttctttattttcaaaacttttagaaaaattgtctaaaatttgaaacgttgaagctataatttctacagtatatcttttttgatcattctgatctttccaagttcttgttttgatagaaccttctatataaactcttttccctttagataaaaattgtttagcaatttcagctgatttgttaaataatataacacgatgccattctgtagtttcaacaaattcttttgtatttttatttttatatttactattagttgctaatgataatgtggctatggtttttccatcagatgtgtaactaatttcaggattaaaacctaatcgacctatcaatataactttattaactgtacctttagccatagaattttttaaattattaaaataatttattatattatacttttttagtaaaatcttcataaaacatcattaaatatgattctttaataagaaattattaaaaatatagttataatatttaaaattttttttaaaaaaaaacaatgaaaaatataaaaattcaaggtgctcgtacacataatttaaaaaatttaaacattacattgccccgtaataaattaattgtcattactggaccaagtggttcaggaaaatcttctttagcattaaataccatttatgctgaaggacaaagacgttatgtagaatctttatcaatatatgcaaggcagtttttatctttgttagaaaaacctgatgttgattttattgatggattatctccttcaatagccattaaacaaaaaaattattcttctaacccacgttcaactgttggaacagtaacagaaatttatgattatttaaaattattatttgcaaggattggtattccatattgtcctgtacataaaattccattaaaaaatcaatctattaaagaaataattcaagaaatctttttactgcctaataaaacagaatgtatgattttagtaccaatagtttataaaaaagaaaaaaaatataaaaaaatattggagaatttttatacacaaggatatatacgagcacgaattaatggggaaataattagattagataatattccaaaattagaacattctcaaaaacataaaattgaaattgtagtagatagattttttattgataagtctttctccaaagaaagattatttgaatcttttgaaaaagctttttctttaacaaaagataaatttgtaatttttctttcatttttatgggaaaatagtattttaaaattgaaagaaaaaatatttagcaacaatcttttttgtcatatttgtaattttcgtgctaaacaattagaacctcgtgaattttcatttaacaaccctagtggtttttgtccatcatgtaatggattaggtaaaaaatattatattaatattaaaaatcttattcctaatgataatctttctatttcagaaggagctattaaattttgggataaaaaaaattcattacattatcaagaattaaaatcattgagcaaacattataactttagtttaaaaaaaccatttgttaatcttgcagaaaaatataaaaaaattattttacatggatcaggaaatactgaaatcatattttcatataaaatgcaaggaggttcttttcaaaaaaaaggaatttttacaggtgtattaatttctttagaaaataaatataagaaaatgttatctaaaaataaagaattatctaaaataattgatattatgacatgtcaagattgtcttggatctagaattaaagaattatcgcgaaatatatatattgataatatgaatattcctaaattaataaaattatccatcaaaaatcttctaatttttttcaaaaaaattaaaataaatttcttccaaagaaaaatatcagaaagaattttaaacgatattattcgccgtttagattatctattaaatgttggtttagaatatttatctttggacagagaaacaaataccttatcgggaggtgaaaagcaaagaattagacttgcaggacagattggttctggattaactggcattatctatattatagatgagcctactataggtttacaccaaagagataataaaaaacttttagaaagtatattgcatttacgtgatattggtaatactgtcattgttattgaacatgataaagaaatcatgttgcaagctgattatattatagatattggaccttccgcaggaataaatggaggcgaaatacttgcacaaggaaatttacaatctatattatcaaatattaaatcaattaccggacaatatttatctggaaaaaaaaaaattcaaactccaaaaaatagaaaaaaatataataaaaaaaaggaattaatactttttggatgtcaagaaaataatcttaagaatatagatatttatttacctattggtttaataacttgtattacaggagtatctggttctggaaaatccactttaatcaatgatacattgtatccattagtttcaaaaatcattatgggaaaaataaaaaaaaactattctaaaaaatataaaaaaattacaggaatagattttttagacaaggtaatttctataaatcaaaatcttattggacgaacgcctagatctaatccatctacatatatgggaatatttgatattattcgaaaattattttcttctgtagaagattcccgtataaaaggttataaatcaagtcgatttagttttaatataaaaggtggtagatgtgaaatgtgcaaaggagatggtcttataaaggtagaaatgcaatttctatctgatatatatgttacatgcaatttatgtaaagggaaacgttataacgaagaaacattaaaaattctttataagaaaaaaaatatttcacaaattttaaatttaaccataaaagaagcatactatttatttcggaatatacctactatatctaaaaaattaaaagcattacttaatgtaggtttaggttatattaaattaggacaatcttctactacattgtctggcggtgaatctcaaagaattaaattagctaaagaactatctaaaaaaaacacaggtaaaactttatatattttagatgaaccatctgtaggattgcattttcttgatattgaaaaattacttttactattatataatcttagaaaaaaagacaatacaattatcataattgaacataatttagatattataaaatcagctgattggattattgatatgggtccagaaggaggtaagaatggtggaaaaattatttctgttggtaccccagaagaaatatcaaaatgtaattattcttatacgggaaaatttttatcaaatttattgtgatttttgagaaaatgatttatccataagctcaatatatgcaatattagcacaatctcctttacgaaagcctaattttaatatacggatataacctccaaaacgtttttcgtagcgaggacctaattcttcaaacaatttatttacggcaaatttattatgtaacttttgaaaagcttttcttcgatttgcaactgaatctatttttgctaaagtaattaatggttcaacaaaacgtcgtaattctttggcttttggcaaagttgacttaattgattcatattgaaaaagagcaattcccatatttcgaatcatagcatacctatggcttgctgtacgattaaattttcttccaattttcctatggcgcattatttatttctctcctttttttttgaagaaatactttcttttttcaatagaattccaattttctaatcgcatacctaaagataatcctttttctttaagaatatttttaatttcatttaaagatttttttcctaaattaggagtttttaataattctgtttctgttctttgtactaaatctccaatataaaatatatcttctgcttttaaacaatttgcagatctaactgttagttctaaatcatctactaatgataatagtacgggatcaattttaggttcttttttttcatctatatcagaagatttcgggacttttaaatctacaaatacagaaatttgttcatgtaaaaacgtagcagctttagatacagctttctcaggactaatggcaccatttgtttcaatttctaaaattaatttatcaagatcagttcttttcccaacacgtgcattttcaacaaaaaaaccgactttcttaattggactaaaagatgcatctaatttaatatttccaatttttaaattttctgactcagattcattataaatattttgataatttgctggaacatatccgcgacctctttcaattttcatttgtatatgaagaaatttattggttgttaaatggcagataattaaatctggattaatgatttttataattccttcaggaaagactatgtcttttgccaaaacaactcctttcgattcctttttaatttctatccaagcctcttttttttttttatgcattttaattactaataattttaaatttagcaataactctacaatatcttcttttataccatcaaatttagaatattcatgcatgacattattaattttaacctcagttacggcgcaaccagatatcgaagataatagtatacgtcttaaggcattgcctaaggtatgtccaaatccacgttcaaaaggttcaagaataactttaaatgtattttttttaatattgattatatcaaccatacgaggttttaataattgatcactttctaaaatcattgaagtactcctaattcaactttaaaaaatcattttgaatacaattcaactattaattgttcattaatatcagagtataaatcagagcgttcaggtaaacgtttaaaaactccctgaaattttttctcatctatttctatccatgtaataggaacacgttttttaaacaattctaatgaacgtataattcttacttgtttctgggattttttacaaattgtaataatatctccttgttttaatatatatgaaggtatattaaccaatttattatttactagaattgatttatgcactgttaattgtcttgcttctgcacgagtagaagcaaaccccatacgataaactaaattatctaaacgactttctaaaatttgcagtaaaatacttccagtcgaaccctttcttctagctgcttctttataatattttagaaattgtttttctaaaatattatataaacgttttactttttgtttttctcgtaattgagaaccataattagaaaatctactttttttatttccatgaacacctggcgtagaatttatattacattttgattctaaagggcgaataccacttttaaggtaaagatctgttttttctcttctagaaagcctgcatttaggaccgatatatttactcataactaactacacccgacgttttttggaaggtctacaaccattatgagctaatggtgttacatctctgatgcttaatactttaattcctttaatatgaaaagctcgaatcgcagattctctgccaggcccaggacctttaactagtacatctacagtttttacaccatattctgatacagaatcacaaagcttttctgctgcaacttgcgctgcaaaaggcgtgctttttctagatcctctaaaaccacttccgcctgcagtagtccaaccaatactatttccttgataatcagtgattgatataatagtattattaaaagaagcgtgaatatgagctattgcatcagttactattctttttgtatttttctttttactagaatttttatttgatttcactatatatattttttccttaaataaaaaagaaatttaatttaaaaattatcgtaaattccattttattaaattaataatttacgaaattttttagatgtttttgcattagttttagttctttgtcctcgtaatggcaaacggcgtctatgacgaatacccctataacttccaagatctataagacgtttaatattcatagatatatctcgacgaagatcaccttctataataaatttttttatttcatttcttatagattcaatttgaacttcattaagttctattatttttttttgacagtttattccaatggaagaacaaattttttttgctcttttccttcctattccatatattgaagttaaagaaatatcagtatgttgtgtatctgatatattaatccctgctattcgaaccatagttttttatgaaaaattcctttaaaattaataagtttttgtaattatagatacaaagctctaaattttacctttagatcatgcaaattgcaagaaattttatccttgtctttgtttgtgtcttttattgcttttacaaattattcttataactctttttcttcgaataactgtgcaatttcgacaaatttttttaactgaagctctaactttcattgatatattcccagtaatattctaaataaaaatatataaaatttcaaatttataatattttatatttaattttttttaaaatttatattttttaatagtgaataatgacgatttgatattaaataactttgtatctgtgatataaaatccattataactaccacaacaattaataatgatgtacctccaaaataaaacggaatattccatattgtatgtataaaaataggaaataaacaaacaaatgttatatatatagatcctattgtagttaatttagacataattaaatctataaattttgctgtttgttctccgggacgaataccgggaataaaagcacctgtttttttaagattatctgcagtatctttaggattaaaaactaatgcagtataaaaaaaacaaaaaaatacaattaaaaaagcaaatataatagtatataataaagttccaggataaagaaatagacttatgttttttaaccaaaaaaaatacttaatattggaaaaccactgaaataaagtacttaaaaataaaagcatacttgatgcaaaaatagcaggtataacacccgacatattaatttttaaaggcaaatgactatcttgtgttgtatatatccttcttccatgttgtcttttagcataatgaacaggtatacatctttgagctttttcaaaatatataattaataatattacaaaaaaaatagatataaaaacaagaaaaaaaataactaaatataaatttccttctcgtacttcttcaaagacatgaattacagcatttggaattccagacaaaattccagctgtaataataattgaaattccatttccaattccatattcactaatttgttcgcctagccacattaaaaacatagttcctgttgttaaagtaaccatagaagtgatataaaaagtactagaagtataatatactaatttttgcatgactacatattgtgttatagccaaagattgaaatattgataagattgcagcaaaatatcgtgtgtaactggtaatttttctttgtcctatttctccttctttttttaattcttctaatttaggaatagaagaagtcattaattgaattataatcgaagcagaaatataaggcataattcctaaagcaaaaatagttaaacgagataaagaaccaccagaaaacatattaaacattcctaaaatagaattccccttaatatgaaaaaaatggcttaatttttctggattaataccaggaactggtatataagaaccaatacgataaattaataatcccaataaaacgaaaaatatttttttttttaattctaaaaatgtgttattttttttttgcaacataattaactacttattttaccacctgtactttcaataatttttcttactccttttgtcactaaaattccttgaatttttattggaaaatttatattaatagttctttctttggaagaataaattttaacaaattttatattattttttacaatatttatcttttttaaataagataaatcgattatttttggaggtttttttaatttatttataatattgacaaaagaaattttttttgtatataaatttttactggatttaaatccgaatttaggtacacgtctttgtaaaggtgtttgacctccttcaaatccaactttatgaaatccaccagatctagatttttgacctttgtgtcctcttccacaagtttttcctattcccgatcctattcctcgtccaacacgttttttatttttaatttttcctttttgtaaggagattgtatttaaatacatcattatatttcttctacctttaataaatatcgtaccttatttatcataccaatattttcaggggtattcttaattttaactttttgatgaatttttcgtaatcctaaacctagaacacagaatttatgtttcttaaaacgaccatatatacttcgtttaagagttacttgaataatttttgaattgtatatttttttcataacatgttctacataaattttaaaaattaattatattttaaatgtctttttctttttttataaacatattcaggatacatactattttttaatccattaattgttgcttttacaatattaattggatttgttgatccatatgctttcgctagaacattttttattcccaaaacttcaaatacagcacgcatagaagctccagcaataattccagttccttcagaagctggcttcatatatattttagatgaacaatattcgctaataatagggtaccataaagtattaccatttaattgtactcgtatcatattttttcgagcattttccatagcttttctaatagcaacagagacttctttggcttttcctcttccgataccaatacgtcctacaccatcgcctacaactgttaatccagaaaatccaaatattctaccacctttgactacttttgtattcctagaaacagttaataatttttcaattaatccatcacttttttgaatatctaaattattcatattaaatcaacctgtttgtttaaaaatttaatccatattttcttgcagaatttgcaagtgcttttatacgtccatgatacaaaaaacctcctcgattaaacgcaacagaaaaaatattctttttaattgcgcgtttgctaattttttcgcctattaaatttgctgatttaatatttccagtatatttcaattttttagaaatttttttttctatagttgaagcgcttactaatgttatattcttttcaatatcaataatttgtgcataaatatgtttagatgtacgatgaacatataaagataattttccctgttttaaaatattatttttgattttcttttttcttcgtattcgagaatcaattttttttattttcatctataattttcctattttttctttgaagatttacggaatatatattcattttcatatcttatacctttacctttatagggctcaggcggcttataagatcttatttctgctgcagtttgtcctaataatcttttgtcagaactttgaattataatttctgtttgattaataatttttatatcaatcatttcatgaactgcatatttaatagaatgagaaaaaccaagcattaaatataatatattattttctaattttgctcgatatcctacacctattattaagagttttttttcaaattttctttgaactcccaataattgattgtaaataatactacgggcagttcctgcttgagaccaagattttttagaatctatttttacagaaatagaaattttattttctttttttagaacctttataaggttatgtactttataagtaaaacttcctacaggaccttgaataaaaataaaagattcagaaatttttatttctacatttttaggtattataatatttttttttgctattctagacatagaattattatattctccttattaaatattttcttaagctatataacaaataacttcaccacctaattttaaatttctagcagaatgatctgtcatcatgccttttgatgtagatataatggcaatacctaatcctccaaaaactttaggaattttcttataagatttataaatacgaaggcctggtttgctaattctcttgatcatatcaaccactggtttatttttataatattttaactcaattgaaagttttaatttaatttttccatatatataaaaattttttataaaaccttcatttttcaaaacttgacaaatttcttttttttgttttgaagaatacaattttacaaatttcttttttgaattttgtgaatttcgaatttgtgttaacatatcagaaataggatcttgcatgctcattttatttatatttccttaaaaaatctattaccaacttgccttttttactccaggaacatcaccctccattacacgtctccgcagttcagtacgtgataatccaaattttcgatatactcctctagaacgtccagtaattttacatcgttgtgttaatcttgatatactggaatcacgaggcaattgctgcaattttaaatttgctttccatttatcttctgcttttatattaggattttttattatatcttttaatttttttctttttatagcataacgagaaattaatttcatacgttttttttcacgagctatcatacatttttttgccatatttaatccttttatttttttatgagaggaaaatttaaagcatttaacaagaaaaaacattctttattattatttgctgaagtagtaatagaaatatttaatcctcgtattatatcaattttatcataatcaatttctggaaaaataatctgctctttaatgccaaaattataatttccatgtccatcaaatgatttattgcttaatcctctaaaatcacgaattcttggtattgcaatatttaataaacgatctaaaaattcatacattctattatttcgcaatgttaccttacaaccaattttccatccctcacggatcttaaaaccagaaattgatttttttgcttttgtaatcaaaggtttttgccctgaaattaatgctaagtctttcatagcatattcaagtttttttttatctttttctgcatttcctatccccatatttaaagtaattttaagaatttttggaacttgcataatatttttataattaagtttttttttcaaatatttaataacttttttttgataaaatacttttattcttgtcataatttattacttatttaataataatttcttttttattagatttaaaacagcgaattttttttccattttttaaaaattgaaatcctacacgatcaggtaattttgatataggattatatatggcaatatttgatgattctattggagattcttttttatgaatacctccatcaattccttttttaggattagatcgtatgtgtttttttacaatatttattccttcaacaagaaatttattgccatttattttttttaaaactattcctttttttcctttatatttaccagaaattacaattatttcatctccagttttaattttcatcatattcttatctctttattataatacttcttctgctaatgaaataattttcataaatttcccttttcgcaattctcttgtaactggtgcgaaaattcgtgtacctataggttgcatacttttatttaataaaacaacagaattggaatcaaaacgtataatacttccatcatttcttcgaatgccttttttggtacgaactatgactgcatttaatacatcaccttttttaacttttccacgaggaatagattctttaactgtaatcttaataatatcaccaatattagcatatctacgttttgatccacctaatactttaatacattcaacacggcgagctccactattatctgctacttttaattctgtttgcatttgaatcatattatatatttattatctccataattttcttaataatatttagttttttattttaatattaatctttattttaaatttaaaaagttattgatttataattttaactaatttccatgattttttttttgatattggtctgctttctttaattaatacaacatctcctaatttcccaatattattttcattatgaacatgtaatttatttgaacgtttcataaattttttatatttaatatgtcgtattctacgttctattaaaacaataacagttttatccattttatcactaataatacaaccttgtaatgttctttgaacaatgtgtttatttttagcaattttcatttagttttctcatttgcaaaatagtttcaatacgtgcaatatttttccgtgcattttttaaaagatgaaatcttattgattcctgcttagaaccacgttgcatatataaattaaatctttcttgtaaaaaatcgcccttcaataattttaattcactaatagatttatcttttagatctttcattttcataacaatgtaatccttttctcaaaaattgttaaaacagataattttgcgcctgcaagacgaaaagcttttcttgctacactttcatgcactccttttaattcatataaaattctacctggttttattggtgcaacccaatattcaacatttccctttcccttgcccattcttacttctaaaggttttttagttataggtttatcaggaaaaacacgaatccatatttttcctcctctacgaatataacgacttattgatcttcgtgcagattctatttgtcttgatgtaatgctaccacgacttattgcttttaaagcgtattctccaaaattaatattcgaacctttaattgataaaccgcgatttcgaagtttttgttgttttctaaattttgtttgtttaggttgtaacattatttttccttattttttttctctttatgtatatatcccgtaaaaatccaaaccttgataccaagtattccataaggagttgaagcaatggaaaaagaataattgatattagcacgaaatgtatgcaaaggaactcttccttctctgtaactttcagttcttgctatttcagcaccacttaaacgtccgctgactgatactttcataccttttgcacctgctttcattgtattttgaacagaacgtttcattacacgacgaaacatcatacgtttttccaattgatatgaaatattttccgcaactaattttgcttctaattccggttttcttatttcttcaatatttatattgatagaaatcccacccattaaagaactaattttttttcgaagcttttctatatcttctcctttttttccaataataataccaggtctagaagaataaattgtaatcttagcgttttttgtgggtctctcaatacaaatcttactaaccgatgctttatttaattttttaaacaaaaaatttcttattcgtatatcagtatttagcatatcagaataatcttttttatctgcataccatacagaattccaattttttatatatccaattctaattccattaggattaactttttgtcccatgaaaaatattactcccttttttcagatacttttatagtaatatgacaactgcgttttaaaattctattgccctttccttttgctcttgcacgaaatctttttaaagttggaccttcatttatataaataatagaaacttgtaatacatcaatatcaagattttcattattttcggcatttgctatagctgattttaacgttttttttatcaaaaatgctgcttttttagggctaaaatctaaaatatttattgctttatctacagataaaccccgaatttgattagctactaatcgacatttttgtgctgaaatttttgcataattataatgtgctgtaacttgcataatatacctttattttttttgaactttcttatctgatgaatgacctcgataagttcgagttaatgcaaattctcctaatttatgtccaaccatattttctgtaataaaaacaggaatatgatttcttccattgtggatggctattgttaaacctatcatatcaggaataatcatagaacgccttgaccatgttttaattggttttttttttttttgtttaatagaaaataaaactttttttaataaatgaccatctacaaatggtcctttttttaacgaacgtggcattcttttatttttctcctaattacttacttttttttgaatgtttaataataaatttttctgttcttttgttatttctagttttatatccttttgttagcaagccccagggagaaacaggatgccttccgccagaagttttcccttctccacctccatgaggatgatcaacaggattcatagccactccacgaacagtaggtcgtataccacgatgtcttgaagcaccagcttttcccaaagatattaaattatgttcagaatttgatactgaaccaattgtagctctacatgctaacaaaatttttcttatttctccagattttaatctaagaattgcatatgatccttcgcgagaaataaatcgtacatatgatcctgcgcttcgagcaatttgagaacctttttttactttaatttcaacacaatgtaaaattgtgcctacaggtatattacttaatggtaaattatttcctatttttataggtgcttctgttcctgaaattattgtattttcaacattaaggccttgaggagaaataatataacgatattctccgtctttatatcttaataaagctatatatgcacttcgattaggatcatattcaatacgtaaaacttttgcaggaatattatccttgtcatatcttttaaagtcaataatacgataatgttttttatttcctccacctctatgacgaattgtaatatgtccatgattatttcttccagatttttgtttttttgtagacaaaagaggtttgtatggttttttattataaattttacatgatctttttatattaactacaaaacgtcttcctggcgatgttggttttattttaattagagacataatttttatatttccttaaaagaccaaaattattctgtttctataaaattaattttataacctttttttagggtagcataagcttttttccattttttggtatatcctttaattttttttcgaccaaatttatggcatttccctttgatatttaaagtttgaatattagatatcttaacattaaataaatattctatagattgtttaatttgttttttatttgcccaatacgctactttaaatgaaacctgattattttttttagtaatattatagctcttatctgtaattctaggagataataatattcttcttaaggagaaagggttttcttgattcaagatagtacctcctctatcatttttaatgaattcatagtaacaataacattatgatatttaattaaaagtaatggatttatataagaaacagaacaaatatttatatttgatagatttctagacgataaatacagtatttcacaaaatttttcaacaataattaagatattttttgaagtacatatgttatgtatttttttttttaaaacacttgttttaggaatatgcatagtaggaatgttatctattaaaaaaaaacgtttttctcgtactaattgagaaaatataacgcgcaaagcatttttatacatctttcgatttattttatgataggacaattttgtttttcttgcagcaaaggtgacaccgccagatctccatataggacttcttattgtgcctgctcttgctttcccagttcctttctgcttccatggttttgatcctccgccttgaacttcagatctatttttttgtgattttgtacctttatgagaattcatagtatatgatctaattacttgaaaaattaaagatttattatattttttattaaaaatattatcggaagcctgaaaaaaatttttagtaattttcccatgattatctaatatagaaaattgcatataaattatactccccttaaatattcaggtttaataattacattcctatttcttgttcctggaacagatccttttataaagataagatttttcaaagaatcgatttgcataatttctaacgaactaatagttttttgaacattccctaaatgacctgccatttttttacccttaaaaacacgacctggagtttgattttgtcctatagaacctggggcacgatgtgataaagaatttccatgactactatcttgtgaatgaaaattatgacgttttataactccggaaaatccttttcctttacttatgcctgtaacattaactttttgtcctacagcaaaaaaatccactttaaatgcatatccaaccttatactctttattaatattttctaatctaaactcccaaagtttttctccaggttttaaattagatttcaaaaaatgtccagataatggcttatttatacgtgatcgctttttagatcctttagtaatttgcaatgcattatatccatctttatcttttgttttaatctggacaataatattgggttctatccaaattatagtaaccggaataaaacatccagaactattaaaaatatggctcattccacatttttggccaatcaaaccaattgccattttaacctcatattcatttaatattacatattattttaatagatattgcatcttatcgtaaacttatcttaacgtctacacccgcagccaaatctaaacgcattaatgcatctacagttgaagaacttgctacaattactataagacgtttatgcgttcttatctcatattgatcgcgtgcatctttattcacatgtggagaaattagaactgtaaatctttctatttttgttgggaaaggtataggacctattacttgagcaccagttttttttgcagtatttacaatatctttcgtagcaaaatcaatcaaactgtaatcaaatgatttcaatttaatatatattttttgaattgacattttttaacctacttttactattttaatattttagttactacacctgcaccaatagtttttccaccctctcgcatggcaaatcttaatccttcttccattgcaatagatgtaatgagttctaccgtaatttttatattatcgcctggcataaccatttctatggtatcatctaatttaacatttcctgtaacatctgtcgtgcgaaaataaaattgaggtctatatcctttaaaaaaaggagtatgacgtccgccctcttctttcaaaagaacatatatttctgcttcaaattttgtatgaggtgtaatagttcctttatgacataatatttgtcctctctcaacttcatctcttttaattcctctaattaaaactcctacattatcacctgcgcgaccttcatttaataattttcgaaacatttctacacctgtaattgttgtatttttagtttttttaataccaacaatttcaacttcttctccaattttgactattcctctttctatcctacctgtaactacagtgcctctacctgaaattgaaaaaacatcttctattggtaaaagaaaaggtttttctatatctcttttaggttctggaaaatatttatccatagaatggactaattttttaatcgattcttttccaatatcggaagaatctccatttaatgctttaagtgcagaacctataataacaggagttttatcaccaggaaattcatattgttcaagtaattctcttacttccatttctacaagctctaataattcagaatcatctaccatatcagctttatttaaaaaaactataatattaggaacaccaacttgtcttgctaataaaatatgttctcttgtttgcggcataggtccatcagcagcactaacaactaatattgctccatccatttgagcagctccagtaatcatgttttttacgtagtcagcatgacctggacaatctacatgcgcataatgacgttcattagattcatattctacatgagcagtagcaattgtaatacctcttgcacgctcttcaggagcgttatcaatattatcataatctttaaattctccgccatattcttcagacatgactttagtaatagcagctgttaatgtagttttcccatgatcaacatgaccaatagttcccacattaatatgtggtttttttctatcaaatatcttttttgccatttatacttcctttacgtttttgttttcaataattttatttatatcatgagatggaattttagcatattttttgaattccatagtgtaatttgcacgaccttggctcaaagatcttaaacttgttgcatatccaaacattaatgctaatggtatttcagcttgaatcaattttctattcgattgattttccacattataaacaatacctctacgtctatttaaatctcctataacttctcccatatatttttctggagaaattacttcaactttcataattggttcaagaataacagcatttgctttttttgccgcttctttaaaacacatagaacctgcaactttaaaagaaatttcactagaatcaacatcatgatacgatccatcaaataaagtaacttgtatatctatcataggatatccagacaatacaccatttaacatctgttcttgaatacctttatcaacagcaggaataaactctttgggaattactcctccaacaattttattaataaatttataaccaaatccttggttttggggttctaatcgcaaaaaaacatgtccatattgccctcttcctcctgtttgtcgaataaatttgaactcatgttcaactatcttacaaatagtttcacgatatgcaacttgaggttttccaatattagcttcaatattaaattctcttctcatacgatctataattacttctaaatgcaattctcccattccggaaatgattgtttgacttgtttctttatcggtatatacacgaaaggacggatcttcagaagctaattttcctaatgcaattcccattttttcttgatcttttttagttttaggttctactgatactgaaattactggttctggaaaatccattttttctaatataataggattttcgatattacaaagagtatcaccagtagaaacagatttaagaccaatagctgccgcaatgtcaccagaataaacctgcttaatttcttcacgtctatttgcatgcatttgaacaatacgtccaatacgttctttttgttttttgattggattaaatacttgatcgccggtttttaaaattcctgaataaattcgcaaataagttaaattacctacaaaaggatctgttgcaattttaaatgcaaaagcagaaaaagatgaattttctatattttgatttttcaatccttttatttccacttcattaggtgcaggtaaaaattctataataccatctaaaactgattgtactcctttatttttaaaagcagaaccgcaaaatacaacacaaatttcattttttattactcgttttcgtaaaccttttttaatattttcctcagaaaggataccattatttaaatataaatccattaattcttcagatgcttctgcagcagcttcaatcattttttctctatattgtaatgatatttcttgtaattcggatggaatttttttatattttaaagttaatccttgatctttattattccaaataatagctttcattttgatcaaatcaataacaccaataaacttttcttcaattccaatatttagttgtactggtatagctatcgcatctaatcgctcttgtatttgtttaataacataaaaaaaatcagctcctgctcgatccattttatttataaacacaattctaggaactttatatctatcagcctgtctccatacagtttcagattgtggttcaacacctgaacttccgcaaaacactactactactccatccaaaacacgaagtgatcgttctacttctatagtaaaatctacatgacctggagtatcaataatattaattctatgttctggaaattggttaagcatacctttccattttactgtagttgcagctgaagtaatggtaataccacgttcttgctcttgttccatccaatccatagttgcagctccatcatgcacttcaccaattttataggtcataccagtataaaataaaattctttcagtagtagtagtttttcctgcatcaacatgtgcacaaatacctatattcctataataatttattggaattaatctattcatgatatatatttatcccttgatataaaattattaaattaccatctataatgtgaaaatgctttatttgcttctgcagctctatgaatattatctcttttttttacagtagaactgcgtccctcaaatgattctattatttcatttgcaagtcgtttttccatttttttttcttttctaatacgagcgctttctattaaccaacgcatagctaaagttttacttctttctacctgaacttctattggaacttgataagtagagcctcctacacgtcttgattttacttcaacaattggttttgcattttctaatgcagattcgaatatcattaaagaagttttctctttaacatggttcttaattatttccaatgcattatatacaattttttctgccacagatttttttccattaaacattatttgattaataaattttgttaacaactggcttccataaattggatctggcaaaatttttctttttgatatttctcttcttctagacattatatttttttcctaaaataaataattctttcgtattataatatttaattttttaattttttagatccatattttgatcgaccttgttttctattttcaacaccagaggtatctaaactaccacgaataacatgatatcgaacaccaggtaaatctttaacacggcctcctcgaattaatacaacagaatgttcttgtaaattatggccttctccaccaatataagtacttacttcaaatccatttgttaagtgaactctacatacttttcgaagagcagaattaggtttttttggtgttgtagtataaacacgagtacaaacaccacgacgttgaggagaatttgataatgctggaacattagttttaaacttttttatctttcgaggtttacgtacaagttgatttattgttgccatattatttccttaaaaaatttatagttattttaaagtgttaatttgaaataataattatctctaattattatataaactataaaatttattattatattattatataaattataattaccttaaaaataaaatacataaatattaaaataaacgaatacaaaatatcttttgtgtttaaaaaaacaatcgtttttataatgattattttaatttttaagaatacgtcgcgggaattatatccatggtaatgtatttcagtcaataaagaaattaaaaaataaaatttaatttcttttttaaataaaatattttttataattaactttttaaaaaaaatttatttatttaaaaatttatgccaagaaatatcactgcaaaattaaggagtatagatataaattatgatttctgttaaagatagcttgaaaatttttcgtcatggtagtattgaaatacttcctgaaaatgagttaattcaaaaactaaatttaggcaaaccattacgtataaaagcaggttttgatcctacatctccagatttacatttaggacatattgttttgatttcaaaattaaaaaaacttcaggatttaggacataaaattatttttttaattggagattttactgcacttataggagatcctacaggaaaaaatgtttgtagaaaaacattaagtttagaagaaataaaaaaaaatgttaaaacctatcaaaatcaaatatttaaatttttagattcaaaaagcactgaaattgtttttaattcttcttggatgtataaaaaaaatgcactagatattattcaattatttgcaaaaacaacaatatccagaatattagaacgtaatgatttttgggaaagatttaaaaaaaaaaatcctatttttattcatgaattattataccccataatacaaggatatgattctgtaaaattaaatattgatgtagaaataggaggtactgatcaaaaatttaatttgttaatgggtagagaaatacagaaaaattatcaacaaactccacaagttataataacaatgcctttgttaccaggaatcaatggaatacataaaatgtctaaatctttaaataattatatttctattaatgaaagatccaatattatttttaataaaataatgtctatttctgatgaaaaaatgtggaaatactacgaattattaagtatgaaaaaaatagaaaaaattaaaatattaaaaaatatgtgtaacctcaaaaaaaagaatcctatggatgttaaaattaatcttgcaaaagaattggttatgcgttttttttcaaaaaaagaatcggaaaaatcttatttaaattttttttatcaatttcaaaaaaagaaaattcctgatatattgccaatgatatcaataaatattgaaagagaaaaaatttttatttgtcaagcattaaaacatgcaaatatgattaaaagtcatagtgaaggatttcgattaatccaacaaaatgcaattaaattaaacactaaaatagttgataatccaaaatatattttaataaaaaataaagaatatatagtccaagttggaaaaagaaaaataaataagctaataatattgtaaatattttgttaataaaatataatatctattcaaagaattaaatttaagatacaacatgggtctgtagctcagtggttaagagcacacccctgataagggtgaggtcgatagttcaaatctatccagacccaccattttggggccatagctcaattggcagagcatctgctttgcaagcagaaggttgggagttcgattctccctggctccaccataaaatacttttaatcttctttaatcctctatagaaaaagaagaaccacatccacatgtaacttttgcattaggatttcgaataacaaattgttctccatttaaatcagatttataatcaatctcagctcctataagatattgataactcattggatcaattaataatgttacatcatgatttgtaattttcatgtcatcatatgcaatatcttcatcaaaagtaaatccatattgaaaacctgaacatcctccacctctaataaaaacacgtaaatttaatttagaattattttcttctaaaattaaatttttaactttattagcagcagaattcgtaaaaataattttttgttttttactatccataattttattcctctataaaatttctaaatattatttaatataatttttttatatattttttttcttttttcttgtgttaattttgatagaaattttgccaaatcagaagcttttaattttttatgtaaaagtgatattagtatatttatatctgtggtaatttcttttcgcttgtaagatcgacaaggttcaactagtaatacaaattctcctttttgattttttatgtcgcattttatccattctaaaatagaatctatatttcctgtaataattttttcaaatttttttgttaattcttttgctaaaacaattaatctttctttttcaaaaaatttagacatcatatttagtgtattaattattctatgtttagattcataaaaaataattgtatgatcaatttctaaaatactttgtatttttaaaagcttttctccatattttcttggcataaaaccaataaattcaaaatggtgtgttggtaaacctgaaacagataatgctgcaattaatgcacaaggaccaggtattggagaaattttatacccattttttttaactttttgaactattttatatccaggatcgtttactaatggagtgcctgcatcgctaattaatgcaagagaatttccaatatttaatttatttaaaatccattgaatttttagttcttcattatattcatgtattgatataattgatgtttttatacaaaatttttttattaagattcttccatgttcaagattttctaacaatatataatttactttttgtaatatttctatagctcttaaagagatatccgataagttaccaataggtgtagaaacaatgtataatacagatttttttttcatgaatattattttatattttattctaaaattttctagacgattatctaaatattattaattgaaatattttaatttaaatataaataaaatattctttatttaaaaaataaagacaatgtaataatcatttttatttaattttcaaagatcttttattttttataaataaattataaaaacaatttctttaagaaagatacattttaaaaaaaatgtattaattattttcttgcattaattatagataattttatatttaagattgctttttttaagcctaaaaatattgaatcagaaataatactatgtccaatatttaattcttgaatttcaggaatcgaagcaatagcatgtatattttcttgatttaatccatgccctgcatggataatcattcctaatttttttgcatatttaatggaatttttaattaattgtaattcttttttcttattataagaatttgatgatgcataatatccagtatgaatttcaattatatttaatccaatgtttttagcgcatttaatttgtaaataatttggatctataaaaactgatgtaattataccggcattatgtaattttttataagccatttttatagaaaaaagattattaagaatatccaaacctttttcagttgttaactcttttcttttttcaggaactaaacaacaatattttggttttattttttctgcgatgtttatcatttctttactaatagaaatttctaaatttagacaatcaggaaagatttttactaattcaaatacatctacatcttgaatatgtcttctatcttcccttaaatgtaccgtaattttatctgctcctgaatttttaataatttttgctgcttttataatgtcaggataatttgtttttcgagactctctaaggcttgcaatatgatcgatatttactcccagtaaaatattttcttttttttggtatttcatacaataaataattatataatgttttgtaactaattttaaaataatataaaaataaatttatttgtaaaatgtaaaaattaaaaatttttaatttaaaattaaaaaataaaattatataatctaattaatatttaaaaaaatattatttaaataactgtaaatgatgctcaaaaatgaatattttatgaatatagctcttaaagaagctaaaaaagcttatcgtattaatgaagttcctgtaggagctgttgttattgaaaataataaaattattgctaaagcgcataatcaaatgattaaagacaataattgtacagcacatgcagaaattttagcattaaaaatcgcttgcaaaaaaaaaaaaattatagattaaaaaagtgtaaaatatatgtaactttagaaccatgtttaatgtgtttaggtgctatgattaacgcaagaattcaatccttaatatatggtgcttctaataatgaaattaaattattttcaagagaatcaaaaaaaattttaaaaaaaataaaaaatagaaaaataggatttacaattattcataatattttacaaaaaccttgttctaatatattaatttctttttttaaaaaaaaaagataattttttaattaagtaattttaaattacttataaaatcattttttaaaagatgcgacccataacgagttactatttttgctgaagttttagttgcaaattctgctgattttttccaacttacaccttgtgttattccagccaaaaaagtaccggcatacacatcaccagcaccaagtgtgttaatttttttaacattattagctggaatcttgtataaattatctccatcaaaaactatagatccatctttaccgaaggttataacaaaagttttacaattttttttcatagaaaaaattaatttctttaacgaatttgtttttgtatatgctttggcttcaaattgattacaaaaaattaaatctataccattttctattatattatctattttttccctaaaactatctatgatagaaacatcagataatgttaatgcaatttttatattttttaatttagcctgtattataatattgcatataagattatatgtattttttgatgcgattaaatatccttcaataaataaatatttagattgaaataaagcatcaaaatttatattattttcatttaattcattactagttcctacgaaagtattcatagttctgtcagaatcttcggtaataaaaatcaaacaattacctgttttcccattttgggaacatatattttttgatttattacaatgaattcctattttttttattttttttatataatattttcctaaactatcatttatggcattaaaactaaagaatgttgttcctttaaaataattaatagctaccaggctattagctagagaaccccctatgtgtttttttttgcaatagaaagaatgttttttgagtatttttaataattctatttttctctcttcatttattaatgttgttatacctttataaatattatttttttttaaaaattttgatgatactaaaaactctatatctaataaagcagtgccaattccataaacatcatatttcataaatttattaacaattaaatttattatttaatttatataatattattaagtatatttatatacaatagaatatttctataaaatagaatatgtttgtgcaatatttttatatatataaattattttgataatattatgaataaaacaaattttatataaaattatgataaatcaaaattatcttaaaaagaaattagcagaaaaagctattaaatatataccttatggtagtgtattaggtataggaacaggatcaactataaatttttttattaatgaattaaaaaaaatacaaaataaagtaagttttattatatctagttcgcatatttcaactgaaaaaatgtcttctttaaatattccagttaaccatatacaaacagaacttcctgaaatagatatttatattgatagtgctgatgaaattaattcatcatttcaaatgataaaaggaggtggtggagcacttacaaaagaaaaaattattgctacatttgctaaaaaatttttttgtattattgatcattcaaaagaagtaaaaaatttaggatcatttcctgtagccgtggaagtaattcctatagcaaaaaatttagttattaaagaattaaaaaaaataggtggaatttcaaaattgcgaaaagattttattactgacaatggcaacatcatcatagatgtatatgatcttaatatcaataatcctaaaaagatagaatcttatattaataagattactggtgttgtagaaaatggtatttttgcgtatcgatctgctgatatggttttagtttctactcctaatggagtattgaaaaaagaacaaatcatatactagaattatttttataaatatgtcattatatgaagatatattgtaataattataattaaaaaatgaatagaaaagtttatatccgtaaggaaataaatcatgaaaatgaacaatttaatattagaaaattaaaattagaaaaattaaaaaaaactggaaatccatttcctaattcatttaaacctaatatagatataaaaaaattaaaaatacaatattcaaaattttcaaaaaaaacattacaatttataaaaagacaatataaaatatcaggaagaattacatcaaaaagaataataggcaaagcaagtttttattctatacaaaatatagaagattctattcaaatttattttcgtaaagaacagtctcaaaaaaatatggataaagtatcatgggatataggtgatataattggggttgaaggaaaagtatttaaaacaaatacaggagaattatcattatttgcagaatcaattatcttattaactaaatctttaagatctattcctaataaattttatggtcttctagataaagaaacacgttttcgaaaaagatatttagatttaataacaaataaaaaaagtcaggaaatatttaaaattcgtttcaagataattcaaaaaattcgtgaatattttataaaaagaaaatttatagaagtagaaactcctatgttgcaaaatatagctagtggtgctatagcaaaaccttttataacataccataataatcttaatatgaaaatatttttaaggattgcaccagaattatatttaaaaaggttaattataggtggatttgaaaaaatatttgaagttaatcgtaattttcgtaatgaaggaatttcaaaacaacataatccagaatttactatgttagaattttatcaagcatatgcagattataatgatttaataaaattaacagaagacttaatttgtaatatttctaattcaatatttggaagtactattattaaataccaagaaaatatttatgattttggtgtaccttttaataaaatgactatgttggaatcaatattaaaatatttaccagaagtaaatattaatcaattatcggatgaagaatctgcaaaaaaactagcttgttctcttcaaattaaaatagataaaaattcaacattaggaaaaattcaagctgatatatttgaaaaatatatagaacataaattatgccaaccaacttttattacagagtatccaatagaagtttctccgttagctagaaaaaatgaaaaaaatcctttagttacagatcgttttgaattttttattgatggcaaagaaattgctaatggattttctgaattaaatgattctgaggatcaaaaaagacgttttttacaacaaattaataaagatcctgatgatcaaatgcaatttgataaagattatatagaggctttagaatatgggttgcctccaaccgcaggagaaggaattggtatagatcgtttagttatgatatttaccaattgttcttctattcgagaagttcttttgttccctcatatgaaaaattaaaaaatcaatgtatttttctaaaaaatattttaataaaactctcataaccattaaaaatccggatagtccttattttataataaattcttttgataatatcatcattatgaataattttaaaaaatattatatccctgtaataatattttccaataaagatcctatcatgtatgatgataatattaagataaatttttttaatattgatttaatactttttggttgtgattcacaatcacaaaataaatttaataatttattaattaaattatgcaaacaaaatataggttttgaaattactaatcataaatcagcatgtcgtacttttaattttcttcttgatcaaggaaaaaaagtaattcttattttgatataaatgaattttataaaatataaaatattatttttttaagtgataattctttttagttaatttattttttttccatatttttatttttttatgattaccagaaaataaaatgtctggaactttttttcctctccatattctaggtcttgtataacaaggaaagttaataacgtttttctttgcaaaagaattttctagtatagattttttattatttaatgtattaggtaataatcttataatagcatctaaaaacatcatagcaggtatttcgccacctgaaacaataaattttccaagagaaatttcttcatctacatgagtgtctaaaactctttgatcaatgcctgcatatctaccacacaataaaattatagatttaatattctttgaaatttttgttgccattttttgttgaaataatttccccttaggggttaaataaataacttttgcttttggaagctctttttttgcttcttctatagatatagcaattggttctggcgtcataatcattcctgcaatacctccaaaagctctatcatcaatagatttataaagattagaagagaattttcggggattaatgaatattaaatctataatttttttttttatagcacgaccaacaacaccaatttctttaaattgttgaaaatattcaggaaatattgtaataataatacatttcattctaaaaattagaaggccaatcaaccaatattttttttttttttaaatttactgatataataacattagatatatatggaattaaacgtttttttttgttattttgtacaaataaaacatcatttgccttagtttctataatataaagaattttcccatatttttctccttttatagaaattacctctaaaccttttaaatctatataataaaattcattatatggaagatcaggaaaatgattaatatgatttttaattccaatatatgagtttactaaattttttgctatttcaggatagtcatatcctgatatttttattaaccaatttttttgatatttttttaaataaaaaggagaaatttgtttccattcttgattttgttttattttccaagaatttttattaattctatttaaacctatttttgtaaaatcatataattttaattttccttttaatccatatgttgatccaatttttcctataataatcagtttattcattctatgaaaaatataaatttatcaagtataatatattttaaaaaaaaatattaaaagttttctttattctaatcagcaaagagaatatatttaatataattaaagattatataatttgtttataatttataaaaatgaaaaaaattcatattgtattcagcatatttttttctattattttatttggattttcagaaaatgttttagataaaaaaaatataattttatataaagaacaaaaagaaaaaaaaacaattaatttattgtataataaatctttttctaaatccaaaattttgaataataaatggggaaaactatctattttccctcctaaattattagcaaaaagctggattcttatggatgcaaaaacgggacaagtattaatacaaaataatgcaaatataactttttctgagaaaaatcttccaaaatttatgttgttatacataattgaaaatgaattattacaaggcaatattcaaatttctgatataatcaaagtttcttctcctatatcatggactaatgaaggatcaagaatgtttattttgtctaatgtaaaaatatcagttcaagatctaataaaagaaattttacagaattcaggaaatgattcatcattagaattggctaaatatatttctggaacaacagaagaatatataaatatcatgaatcatgtggtccataatttaaaaatgcaaaatacctatttttttaaagaaaaattatttaatttgcataattattcttccgcatatgatatggctttattagcaaaagctttaataaataaaatagataataatcccaatcattttagcaagttattaactaatatatatcctaataaattactttttctatatttttctttatgtatatttaaaaatgatccaatcaaattatttcaatattcattagtaagtatagaaaaaatgaaaaataatcctatgaaacttatttgtgttgttataggaaattctagtatagataaaaatattacagaaactaaagctttattaaattatggatttcaattttttaaagaaaaatgtatttataaaaaaaatgttctaattaaatatgttcctatctctttaggaaatcaatctcatatacctattggcgtaccttataatttaattttaaatttgcctaaaaattataaaaaaacatcattaaaagcaaatttaattataaaaaaaaaattatatgctccaatttctaagggtgcaaaaattggagatatagaaatattattgaataataaaatcattgcaactattccagctatttcacttctatcgatttctagaattggtatttggcataaaatattctaagttaaattaattaatttttttgcattaattaaatctatttttccatttcctaacttaggtatttggcaaactttataaaataattttggtttaaataaattaggtagatcagaattttttattgctttttttatatcattttctgttatttctttgttatgtataagatataaacattctcctttctttttatcaggaattgatattattaaaatttcagctaaagtattgttatcaatatttttataaattgcgttttcaataaaagataaacttaccatttctgctccaatttttgcaaaacgagaatatctatcatgtatagtaatataaccatcattatcaatgctagcacaatctcctgtacaatgccaaagaagattttctatttgtactaaattattaaataattttttattttttaaatatccgtacattaaatttattccagttgctaataacaatccatgtcttcccttaggaagatctttatatgttaaaggatctacaattttaacaaaacatccctctaaaggtaatccaacagtgaattttttatattttatcgtatgattagtatttttcctattaacggatattaccggagaaagttcggtagttccatatccttcaaatatacatttatgaaatttttttctaaattctgtagaaatatgtttttgtaatttttctcctccagaaataatcatttttacagaaattaaatgattgaaattaatatatatattttttatgtataatcgcaaaaaagaaggagtagtacaaattaatgtaatttgatatttttttattaattttgcagttaatttaatattccttggatcagaaatttgtattgatggcattcctgtaattaatggaagtaatacagaaatagttagtccaaatgcatgaaacaaaggtaatgaacctaaaattttatcattttttgaaatattaaaagattgagcgctttgtaaacaattagcaatcaaattttcatgtgttaaaattataccttttggtatattttcactcccactactaaataaaattactgctttttctttaggattaattttagaagaaagtgtagtttttattaaatatttaggtaatattagtaccaaaaaaaatgaaattattttattaaatacagtaatatcttcttttaaactttctaaatataaaatttttttatcctttaaaggagaattataaaataatttattagataatgtctttaaaaatcttttagaacttataataatattaatatttgtttgattaattgcatgaataatattttctgcaccagaagtataattaagtggaataataattttttttagacttaataatgttaaaaatattactacagtaaatgtagtagatggtaaaagaatgcctatataattttcattcttaagaagattaaatagtttttttcttaaaatccatacagaagtgataaaattaattcccgaaagtttattttcaaaatcatctgaaatagaaatttttttattccaacaattttgtgtatttatccactggtgaataataggaggaaatttttgaatatgtttttcccaactattaataacaaaatttttccatttaaaatcgttttttttatatttaatatttagagttaaaaaagaataatttttattgccaatagatttagattttccacataaatataaataatattgtaatttaatattatttactaaatttatattattttgatttattaatataattgtttttgaaggaatattttctatagaaaaatttttataaataccaaataatgataatatatttaatatatttatatcagaattaatgagaaaaacttttttacctatccaaaatctaattaatattgttgtaataatagaatgttcttgagaaattataacaattttttgatttaataaatataattcatttggtataaaaacttgtagcaaacgatattttttaaatatgtataaccatattagaaccaatttttttagtatttcttttttgtaaaaaaaagataaaaatattattgacagtaatatcataaattttatattcattttataaatatctaaaaattaataattttattatataattatatattctattatacacttcagtaatttttagaaattaaattaacattttttaaaattattgaaaaaaaattttaataaaggagtttaaaattgaattattctggatatcttacggttattaatacgataaatcctagcaaaagtgttgattcttatattcattttgctaatagtatttctttgcttacagaagaagaagaattttattgcgcagaaaattttaaaaaaaataatgatttatattcagctcaacgtcttattatgtctcatttaagatttgtaattaaagttgctaaaggatttaatggatatggattacaattatctgatttaatacaggaaggtaatattggtcttatgaaagcagtaaaaagatttaatcataaacttggtgttcgacttgtttcttttgctgtacattggattaaagcagaaattcatgaatttataatacgaaattggaaaatagttaaaattgctacaactaaagcacaacgtaaacttttttttaatcttcgaaattgtaaaaaacatataggatggttttctcaaaaagaaattcaagatgttgcagatactttaaaagtaaaaactactgaagtaatagagatggaaaaacgtatgaatacatacgatcaaacatttgatttattacaagattacgatcaggaattttcatatcatctttatccaaatcaatatcttacaacggatgataatgatattgttgatatcattcatcaagaaaatataaaaaaaatacaaaaaaaatctttaaaattagctttaaattgtttagataaaagaagtaaatttattataaaaaataggtggttaaaaaataaaaaaactacacttcatgatcttgcaaaaaaatatttagtttcagcagaacgcattcgacaaattgaattacaagctttagagatattaagacaaaaaattacatattgaaaaaataaaatttttaaatattttataaattatttctttttaagaaaaattaacaataaatttcatatttattgatattttatatatttttttttattggtataaatatatgtttttggtaaaattttagttcattaatagattctttaatatcatataaagctgtatgcattttcttttttttaaatatttttagatttggataccaacgaaaaactaattcttttattgtactgacatctaataatctataatgaaaataactatctaaattcttcatatatttagctaaaaattttcgatcttgatatacactattaccacacattggagaacagcctttttttatattgtttttttttaaaaaattaatggttttttcttcagcttctttaaccgaaacacgacttcgaacaactttatcaagcaaaccagatttagtgtgttgatgcatagaccatttattgatagatagtaaattttcttttggttgaaatattgtgatagaagggccttcatctattatatttaaatattgatctgttataatagtagagatttcaatgatgtgattaaatttgatatttaatcctgtcatctctaaatctatccatataaggcatgtatctttatacatagttttttttaaaaaaaatttttataattaaaattatacaaatattatacatattctaatacattctttgtcttattatttcaaataatgtaataccaatagatacagaaacatttaaactttcaattgtagaatttaatattggaatttttgttaagtaatcactatatttcatagtaatatttcgtaatccagttccttcatttcctgcaataatagcaatgggtattttaaaatttatttggtagattattttagatgcatgtggagttagacctataatccaaacaccagatttttttaatttttttaaaacactagataaattttttacaatgtaaatatttaaaaatttttctgaaccacaagaaacttttcgtacagtttgagtaattggtgatgattgaaatttagaaataattactgcttgcacattagctgctgctgcagatcttaaacatgcaccaagattttgaggatcttgtatacgttctaaaaccaataataaagtattttttgtaatatcatttaataaattttctatactattattaaatagtatttgttcattttttaataaaatgattccttgatgattaattttttgaaaacgagaattatttttactcaataatataattggaatatgcatttttttagaaatattaataatagtttgaatttttctattatattttttttgtaaaaaaatccatattttttttccagatttattatttcttaaataagataatactggatttataccatatatatattcttcatttttcatagaatgatattttatatttattaaatataattacaaaattatttttttaatttaaaacaacatttaaaattttataaaaatgaatttcattttttatgaagataaatatagataatatcagtgatattttctaattttttaataattaattaaatgttgttttaatatagtaatattgaatattactataaaataccataaatttctattatttatttaaatataagaattagcaatattaaaatcatatttactatacgatccttatcatagcatgaaatgctattttagtttatgaaaaataaaacaaatatttagtttttaactttaaaaaatttaatcatgattgtgaaatttagtaatatacactataattttgcaattattaataattccaaaagaactccaataattttttcttccagatttgggtgatattgagaaataagaaactaaatttttttattaatttttaaatctgatatgttttagataaaactttttataatttatccatgatattttttatcaacaatagtatttttgtacatattttttttttaatataaatagagatacatatatttaaactctattttttaaaaagaatttcaaaattatttaaatctaatcctaattagaactatagttctatatcattttatgaaatatctgctttttttaaatttaaaatatataaaatatacatattataatatatatgccccttattgtaaaaggaaattaatccgttttaattatagagtatagaatacattaatttgaaaaattttcagattaattttagattttttgataaatcttttattgatctaattaagaaaatacaataaatattgctatttatttgtaatactaaaaattttacttaattttcttataaattaaaataagaattatttattttatttttagatatttctcttaaggctacaactgtaactttatttttattccaagaaactaaaggttcttcgcctgaaagtaaaatttttttagatcttaaggcagctaatattaccaattgaaatctattatcaactgcatgtaaacaatcttccgttgtaatgtgtaacataaatattataaaattttattttaaaaaattattattatattattatgataataatttcaataaaaattttttttttagtataatacttctgtatgttttatttaattcagattcaataatatattgtatattctgacaagttttttgaaaacatttattcacaagtgtataatcaaattcttgaaaatgggagatttcatcttgtaatgcttccattctttgatgaattattttttctgaatcttgcccacgtttttttaaacgattaaataattctttttttgaaggtggcaataaaaaaatagtaatacttgctttaggaaacatacaatatatttttttagctccttgccaatttattggcaataaaatgttatgtcctttagttaaaagatttactaattctgattttgatgttgcataataatcgttaaatatttttgcatattctagaaaaaaattcttatctttcaattttttaaatttttttaaactaataaaataataatcttttccatgttgctctttttttctaggagttctagtagtataagaaatagtagaaactaaatttttatttttttttaataattcttgtgaaatagaagtttttccacatcctgatggagatgatataataactattatatttgacagtatcactataatatatatttaaattttagaatattttagaatatattaacaattaaagtaaagatattaatctttcgtattaattcttgatttattgttttatgttcttctataatatggattaaatattaaattttaatatgtttgtatattattatgtgtaaaaaaaattctgacaatatcataaaagcaataattgaaattcctgctttcagcaatcctattaaatatgaatttgataaaaaaaataacatattaatggtagatcgttttatatccactactatgcaatatcctgctaattatggatttattcctaaaactttatcaagagataaagatcctatggatatattagtaataacaccatttccattgcaacatggagtgcttattcattgtcgacctataggtatactaaatatgaatgatgaatctggagaagatattaaaattttatccgtacccatttctaagttaactcctatatataatcatatacgtgaaattgaagatcttccgattttgttaattaaacagattgaacattttttttcacactataaagatttggaagataataaatgggtaaaaattattggatggggtaatagtaaaaagtctttttcttctatagaagatggaatgaaaaattattctttgaattttaagaaataattaatatattttttagatattaaaaatgtaatttttttttaaaaaaaattataacagttatatctaaaatagaataaatttttttttatttaatttttatattaatatcttataaagattttaaaattattaatatatataatatgcacatattttaatcataatcatatatccttaatttcataaggactattttggtagctatgggtagatttgaactaccgaccgcagcattatgaatgctgtgctctaaccttctgagctacatagcctccaaaaattaatttaattaaaatttcttatgatattttttctttaatacgagctgattttccttttctatttcttaaaaaataaatttttgatttcttaacatctcctctgcgttttacaataatatctgcaattaaaggactgtacgaaggaaacacccgttctataccttctccggaaactatttttcttacagtaaaagaagagttaaatccccgattttttttagcaattactataccttcaaataattgaaatctttctttattaccttctttaatttttatttttactataactgtatcaccagatgaaaattttggtaattttttatgtatttgtttttgttcaaattctgtaataaatctatatgtattcataatattttatccaaaaaattctgtaataaagtaatactcttaaagtattgtaatttttttttttataaaaaaaaactatttttttaaaaaaattataatttttctgctattttatagtagtatatatattgtatgtaataatatcatattcttttatctagataaaaaatcttaatatttcaaattgttttattttgataaaaataatttatctttttatttcttaaaaggaatttatatttgatatataaaaaaatatactaaaacttttttaagtatatattttttctacatcttatggatatatttttatatatattaaaaatttcttaaaaatattttattaatatattttgcagatatcataatccatgtaggtcttccatgattgcattgattgcttttttcgctattttccatatctcttaataatctattcatttcagaaatactaagtttttgattagattttattgcactataacaagaaattgtgctaagtattttttgaaaaaaaaaatcattttctacaatatttccatattggatgatatctttgattatatcttgtatgcaaaaatatatattctttgttttaagaaaggtaggtatttttttcacagaaactatattattattcgttaaatccaaaccaattccaattttatttaattttgaattaaattttttgatatattggaattctttgtcgctgacacttaaaattataggtattaataataattgggattctattgaatttaatttccataatttttttattttttctaaaaaaatgcgttcatgagcagcatgtatatcaacaataattaaatttttttgattctgagatagaatataagttccataaaactgtccaatagcataaccaagaggggggaaatgataaatatcaagatttttatttttatttaaagaattcaatgaatagttttctttaaaattattttttaaaaaattagatattacaatttttttttttaaagtatgcaaatctatatttgaaatatattgattttttaaagattcttttggattcgtctttttaagagatttctcaaggcttttcaatataaaatcttgtattttttctttttcttgaaaatgaacttcattttttttaggactaatattaatatttaataaattttcatttatttctaaaaataatataaaaactggattttgatttctatatatcaatccacgatatgctattcttatgatagaattaataattttatttttcataattcttctatttacataaaaatattgttggtctttagatatttgagaaaaagttggtaatcctatccatccccataattttaaatttttaatttgataattaatttttaacatatttgaaataaaattttcattaaataaacttttaatacgattagatttttcagtttctgtattagaagccttaatatcataaattattttattattatgaaaaaatctacaattgatattaaaatggcttaaaattaattttttaaccattttactcatgtgtagaaattcattgtactctttaagaagtttttttcttacaggcatattaaaaaataaagagcatacttctaccgttgttcctatgttatgtgcagctggaataattattttatttttgttgtttccgattgtagatattttccatgcataattattattatcttgtctagatataagtgaaaaataagaaactgaagcaatgcttgccaaagcttcccctctaaatcccaaacttaaaatattttctaattctttttttgtataaatcttgctagtatgatgtcttctcgtaattttttgtaaatcatctttatgtattccattgccattatctgttacaataatctttgaaatacctccttgatatattttgatatcaatgcaatcagcaaaagaatcaacactattttcaaataattcttttacaattgaagaaggtcgttcaataatctctccagcagcaatttggctgataatttttttagataattttttaattcttctcataatagaacaaatatatccatcaataattatttattgatattttaatttaatttaattaatgaaaaaattaatttaatttttttttatcaaaaaataaaaattttaatgtataaattacattaatattgttttgctggattttccagataattctttacaaagtctaggaacaagatatccgggaagggattttcgcataatttcaataattttttttgctttttttgtgctttccttaaaatgcgaaactccttctacaggatctaatatatgtaaatagtatggtaatacacctgctttaaataatttttttgataaatcagataaaattttttggcaatcatttattccttttaaaaaaacagattgatttaaaagtattaaccccccctccctatatttaattaatttatagatcacacttttacttaattcattagcatgatttgcatgtattacaagtactattgtataaggaaatttatgtaatgcatataataaagattcagttaatcgatcaggaagaacaacaggtaatctagaatgtatacgtaatattttaatatgagaaatttttgaaatttctattataaaatattttatatgttcatcatttaacattaatggatctccaccacttaaaataatttcataaatttctttattttttttaatatatttaaaaacaattttccattgttttttatttatttgatttgctagataattaaaagattttctaaagcaatatctacaatgaatcgcacaagattttgtgactattaaaagtacacgagatgaatatttttgtagcatcccaggaagaatattagcttttgattcagataaaggatctaaaatatattttaataccttttttttttcatctataattggtaatatttgttttaaaagaggatcattccaatttttcttttctatctgatttgcaaaatgttgagtaactttaaaaggaaatttactatttttatcaatattaaattttgtaccatctaattttaaaaattgtaataaatcatcaatattagaataactattttttaattgttgtttccatgtcatttctatatgtgataccatttatttaaaatattttttaatttttttaaacctattgtttttattttgttagaaaataattgcatagtaataattttattattttctttattataaaaagaatttgctaattttagcattttatttcttgtatatatatttaatttatcagatttattcaatataatatggcatggaagatcactagaaacagtccattttaccatgtgaatatccataggcatttgtatatgcctaacatctataacaattatcaccccttttaaggattttcttttttctaaataaatttcaaaatattttcctaatttttttgttgaactttttgtgaatccataaccaggaaagtctacaattcgacgtattttatctaattgaaataaatttattaaattagtacatccaggagtttttgaacttttagcaagattttttttttgagtcaatgtattaattattgtagattttccagcattagatcttcctaaaaatgctatttcaatccctaaatctttaggaagaaatttatagttctttgaacttgtaagataaaaagctttttgataattaaacatattttaaaattccatgttagagtttaaatttaaaaaattaataaattttatttattaatattttcttcaattaaattgaatataaaattttacaaaatttttttatgtttcataaactatttaacaaataattaaaaaatttaaaattttacatatatataaagatataaaatatattaagataattttttactagaaaaatctataaaaatatttatttttaaaggtcaagtatgaaaaaattttattttaaataaatactaataatcttagtatatatcattaaaaaatataattttataaatatataaaaaatcatgattaataatttacttaaattattaatattttatacgatcaaattaataatatatagatattatttttacataaaaattttgaattcattttatatctatataattattgattaaaattttagaaaatacttatacttaatttatattatattttttacaaaatttaaattgttctttataaatttataatttaagatttaacgataaattataaaaatatatttttttttattatttattgtttatactttaaatttatattaaacatttaaaatttaattccatctaatctagataaatttattagtatccttaaaaaatatataattaaattttttttttattaaaatttacatcggttattatggttgttaaatacatagaattttaaagaaacttaaaaaattcaatgctaatacaaaattaaaatatttttttattgattaattattataatattttaatgaactatgtataatattattaataatatttaaatttttgatatacaatataaatttaaatattttatataaaataaaattcaagggatgaaatttatgaatatttattctgaaataggattattaaaaacagtattagttcacaaacctaatattacacttaaatatattacaccagataatgctgaatatttattatttgatgatgttctttggactgatcttactattaaagaacatgattattttactgatgttttaaaagaacatggagtaaatgtattagtagtaggtgatttactacaagatattttaaataaagataatgcaaaaagatggttattaaataatttaacaaaaaaatattatccctctctctttttagaagacataaaaaattttttaaatcaacaaaacagttataattttatgtcttatataacaggaggattaactttcgaacaattaaaatgcgagaaatcaaaaaataatttaattagtcaagtttttaaaaaaaatgattttgttttaaatccattgccaaaccatttatttactagagatacttcttgttggattggaaatggagtaacattaaattctatgtgttatccagtacgatataatgaaactatcaatattgctgctatatacaaatttcatccattttttaagaacaaaaattttgatatatggtatgacattatttcagataaatttcttccaagtttagaaggtggagatattcttgttctgaataaacgaacattattaattggatttagtgaacgtacaacattactagcaattgaaattctcgcaaaaaaattatttttatctactacttttaataaaattattgttttgaatcttcctaaaaaaagatcttgtatccatttagatacattattaacaatggtagatgtaaattgcttttgtagtgctattccagataaattgcatacatggattattcaaccaggaaataagaaaaatattcatgttagttatagtttaaatcctaaaaaggaaatttctcaatcttttgaagacaaaaatatcagatttatagaaatacaaggcgatttcttttctaggaaacaagaacaatggaatgatgcagctaacgtattagctatttcccctggaaatgtaattgcatataatcgtaatataaatactaatttagcattaaaaaaagcaggaattaatgtaattgaaattccaggttctgaattaataagaggacgaggtggacctcgttgtatgtcttgtccaatagaaagggaagaaatatcattatgaaaaaaattgttattgctttaggtggaaatgcaatattatctcgtcaagataagcttgaagctcacattcaaataaaaaatataaaaaatgctgtaaaagctatagctgaaatagcaaaaaaaaatcaagttgttatttgtcatggaaatggtccacaggtaggtcttctagccataaaagatgaacaatatacttctgtatcaccatatccactagattcattagttgcaaatactcaaggtatgttaggatattggatacagcgtgaattaaaaaattttttacctcaaaaggaaattttaacaattcttactcaagttgttgtggattctaaagatcctgcatataaaaatccaaccaaatttattggaccgcaatattcactaaataaaaaaaaagaacttcaaaatcgaggatggaaattaggtatagataatggaaaaattcgtcgtgtagttgcttcacctaaaccaaaagatatcgttgagattcaaagtatttcttctttgttaaatcataaaaacattatcatttgttgtggaggaggcggtattccagtaattcaagaaaataatatattaagcggcatagattgtgttattgacaaagatcatacttcttcgttaatagcacaacttataaatgctgattttcttttaattttaactgatgtaaaaggaatttatttaaattgggggactgataaacaaaaaattataaaaaacatttctattaaaaatttaatgaaaattgatttaaataaaggatctatgtatcctaaagcaaaggcatgttataattacattaaaaatacaaaaaaatatgcaggaataggccatttaaaagatgcatttgatatttttttagggaaaaaaggcacacaaatacatatttaagatattaatttttgtatttttttagtctctaaaatcggatcttttgcatttaaaattcctgaaataatagaaataccagaaatttttgtttcttttactaaatgtatattttttttattaataccaccaatagcaattattggataatctaatacagatttccagtattttaatctttctattccctgttctttataaggcataaccttagtttttgttgggaaaataggtccaatagaaatataagatggtttaatataatgagcaatagcaatttcaaaaaaattgtgtgtgcttaatcctaatttgatatttttatttttaattagatttaaatcggccgtagtaatatcatcttgtccaagatgaatgccatatgcttgcatttcaattgctaatttccaataatcattaataaatagtttaatttttttaaattttgcaaattttatagcattaaatatttcttcttctaatttcttttgagattttatctctttaattcttaattgaaatatagtacaacctgtttctgataacatttttaattcttgtaaagaagaaactattggatatagttcaatattattattagtatttttatatctagaaaaagattggggaatttttgaaataggtatattagataccaatggaatatcttgttcaaatttaggatagctaacattgttgattggagtatatccatataaagaaatttttttacttagacgaataccttgtgtaataaacattttcgctaacacgacagaactttttaaatcaaaatctaaagctcttgctgaagcaatggctgcggaaaatgcacatcctaatccgtgagtttgaatattttgtattttaggaatattaaaccaatatttttttgatttatctaaaaagaaatctgaagcccaaaatttattattatttccacatttaattattacacttttagctccattttctaaaatttgttctgctgatttttctacatcaataatagattttatttttcggttacataatatttcagtctcaaataaatttggagtaatcaattctgctataggaaataaaagtttttttatcatttcaatggaattgaaatctaataataaagacccagaggaactaatcatgacaggatctaatattataggaatattaggaatatttgataaaagatcaaaaatttttttgataatattaccttttgcaagcattcctattttaatagctttcgcaggtaaatcttttttcaaagctttatattgtgaagatatatgatttaatggaatattgtgaatatctgtaacagaaacagtattttgtgctgtggatgctgttataatactacaaccatgcactcccaatatattcatagtttttaaatccgcttgaattcctgccccacctccactatcagaaccagctatactccatacaattggtagatttttattgtttaattttttcattttttattttttctccaaaaaggagtgcctaaaataggtgtactaggagaagcaaaagaacgttcaggcataaatcctgctttataagccatacgacctgattttacagctagagaaaaactttttgccatttttataggattatgagaaagtgctatagcactattaatcaataatccatcatatcctaattccatagcttgcatagcatgagatggtttgccaattcctgcatcaattattaaatttatttcaggaaatcttttacgtaaggtttttaatgattctgtgtttaatatgcctttcccactaccaataggtgatccccatggcattaaaatatcacaaccaagatttactaaatgattacacaaaactaaatcatctgtgcaaaatggaaatactataaaattcatagaaattaatttttctgttgcttttaaaagaagaaatggattgggttgcaaattataatcatcaccgattatttctaatttaatataattagtttcaaatatttcccttgccattttagcaattaaaatagtttcttttatagaaaaacatccagaagtatttggtaaaattatacaatttattttttttaagatattccaaaaaacttgattttcttttttttggcgacgcaaagatactgtaataatttctgttttgctttcttttatagattttttcattatttctaaagatggatataatgatgatccaagcattaaacgactttttaatttttttcctccaattttccacatattattttgtttatcctccttgcataggtgcaattaactctatattgtcgttggctttaattttggtattattccatgtattttttggaatgaaattcatattaatagcaattgcaaaagaaccttttattttattaacagaaagtaaattagatattgtcatttcagaattaatatttatttttttgccatttaatataattggaatcataatttttataatctcctaaaaaattatttaaaaatatgttgaataattttttcaactattgggggagcaactaaccaaccataacgaaataaaccattaactctgattaatccatttttatgtataattaaatttgaagaataattaggcaaagttggtcggcattgagttgcagttttaataattcgcgcttcaagaaaactagagtttacgctataagcggaagataataattctaatgtagttcttacagaaataggtgaaaaatcataagattcaatttcactagatcctaaaataaatatgttttttggtctaggtactatataaatagatttttttggatgtatcatacgtattggccgcataaatgatatatcagatgtatgtatccaaattagctctccacgaatagatctcaattcagataattcttctttcgcacctaatcctcgacaatcaataacccaatcatattgttttccatttacttcatgaggaatacaatattttatctctattttttcataccaattaatatactttggtaataattcacccatataattcataaatgcttgagagtctatttgtccttccttaggaagccaatatgcatatttcatattaagatttggttctaatttttttaattcttgttttgtaagaatttgtatcttattttttgtatatttttctatatatttaatataatgtgataaagtatcgatatcttgttgatgtgcagtaataatactcccatttttttgaaaaaaaataggtttttttaattcttttaaataagaatcccataaatttagactgtttatacttaaatttaatattgttgagtctaatttatcaagttcagaaaatggtgataatattccagctgcagtcatgctacaattatttatatttttatattctttgtcgtataaagatatctgattggttgaatatctaagtaaacgccaagataataatctaccaataataccagctccaattatagcaattttcattatttatatgtaaaattttatagatataataacatataaaatgtttttattcttataaatttattgaataaataaagtacaatttttttgtctttaacaagataaaattttagattaaatttattctcaataaaattatgaaattaaataaataaaaaatatcaaatattttttatttagattaataatttatatatctttaaataatatatattataaaatgcatttttattttttggtggttcgggacagaattgaactgtcgacacaaggattttcagtcctttgctctaccaactgagctaccgaaccaaaatttaaagaagatattaaatctaatttagattctagcgtcaagaattatttttaagataattattttttatattctccaaatagaaatatattcattttttttaatagaaataaacgagattctttatctaacatattcaatctatattcattaattaatatagtttgttgatttttccacatttcccatgctttagaactaatatgctttaatattttttttcctaaatttccaggatatggagctatatctaaagctggaagttttttttttaatttttgacaataaatataattttgcatgttttttttataaaaaaatataataaattttatatttaaatttatttttatcaataaaatattaatttaatttattaattaaatcttgagaagataaaattttttttattggagatggaattcctaattttaaagcttctttaatttctaagaatcttgcatcccctgaaaggggaaatattttaagattacaaataatagcttgataatttaattcgaaatgactaaatttatgtttttttaatggaaatgaaaaagaaattttatatgattttatgttaataaaatgtttaaaatttttatatgtattaaaaataggaaaacaatataatccaggccaaaaattttttttaggtcttttaattaataaaactcttttatctttttttagaataagaaaaataacttttcgtacttttttttttttatttttataattttttatggaaagaatatttctttttttagataaacaatcttgatttaatggacaagaaagacatttaggtttagatatacaaaatattgctcctatatccattaatgcttgtgtatattctgaaatatatcgatatggtagtaattcttcagataaattccataattttttaattatcttagatgaagaaaaatttttttttattccaaaaaatctatataatacacgttttgcattaatatctaatatagggtatctttgattttgtgaaattgctaaaatagcgccagcagtggattttccaatgccaggtaatgttactaatatttcaaatttatttggaaatattccattataacgagaagtaattattttcgcgctattcaacaaatttatagcacgtctatagtaacctagtccagaccataaagaaagaacctcttcttcagaagattttgcaagctgaataacttcagggaaataaataataaattttttataaaaaggtacaacagtaatagcacgagtttgttgtaacataatttctgatatccatactcgatataaagttttatttttttgccaagggaaaattctttttttatgatttctataccaatgtaatatcaaattactaaatttttttttcataaattttatttaaaaattttaaaattatattttttacatcattatttaataagatgtaaaaattcttcacgaatatgataattattttgaaataaacccaacattaatgatgttgtcatgacagaaaattgtttttttacacctctcatagacatacaaaaatgttttccttctataactaccgcaacaccttgaggttttataacagattctaaacaacaagcaatttcttttgttaaattttcctgcatttgtaatcttctacaaaacatatcaacaattcttggaatttttgataacccaattattttttttttaggaatataagcaatatgacatctccctgagataggaagaagatgatgttcgcaaagagaataaaattcaatatttttaactaaaatcatagaattagtttcagcagaaaatattgcatcattcaaaatatcttgtaattttatttgatatccttgtgtaagaaaacgtattgcgcgagctgcccgtattggagttttttttaagccttttcgatttgtattttctccaatttggattataatttttttaaataaattttccaccttattttcactacaaatcatttataattttagattctaatttatctatattttgtctaaaaataattacattatcaaaccaatttttaacttcttttatagaaggagatatttttatttcttcttgcaagaattcttctacattcaaagaaattttttttaaaacattggttttaattttgggtaaatagggaatatatattccttttatttttaaaaaatttaataaaaataattttatatctaaatttatttgttgaaaaaaaagtttataagcttgtaatatatgtatttttccaaaaaatttaatccttttaggaaaagtttttaattgtaaattatttatttttataaattgaatatatccaaaaatatcactttctaaaacaagatctattatattataattctctttataagaagagtatgaattataatccatattataaaacaaaaatttttttttttttggtattagtaatatactatactgtaaatcagtaaaatttaataagactttagtattaatcaaaggattaattaaaatttcaacatcactttctaaaattagaaatttattgaaaataaattctaataaataaagaaaaaaattttttttcattgttttttttaaaatactaatcctttatggattgatacgataccttttgataaatttatatattgaacttttttatatcctatttttatcatcattttttttaatgattcttgatctggatgttgataaatcgattcagataaataacgatatgctttttcattattagcaataaatttacctaaatatggtattatataagataaatatatattatataaaaatttaataataaaagaatctgctaatttagaaaattctaatataataagacatccaccaggtttaataacattgaatatagaagataaagctttttctttattttctatatttcgaaaaccaaaagccattaaaacagtgttaaaagtattttttgcaaaaggtagagattcagcatcggctattgcataactaatattagatatataacctttgttttctatacgtattcttccttctaggatcatatattcattaatatcacttaatattatatgtcctgaattagataatatttttaatatatttaaacttaaatctcctgttcctccagctaaatctaatatgagatcatcaggagatatattacccatttgaatggctgttttcttccataatctatgaaatcccattgacataatatcgttcattaaatcatattttttatgaatagaagtaaaaatatccataattttcttttttttttctatagaagatagttttgtaaaaccaaaataattattaaaatttttcataatattatcgtaaatattttttatatataggaaatttttgacaaattttatcaactaattttttaatattctgtattttttcattattttggatatcatctaatatatcagatatccaatgcgcgattaattcgcattctgatgttctaagccctctagtagtaatagcaggcgtacctaatcgtaaaccactagttatgaaagctttttgtggatcattaggaatggtatttttattaactgtaatatgtgctttctctaatgcttcttcagctttttttcctgttattttttttttagataaatttattaataataaatgtgtatcagttccttgggaaataacatgataatttctttctataaaaacctttgacattttttttgcgttttcaattacttgtctttgataatctttaaaagataaacttaatgcttccttaaatgatacagctttagctgcaataacatgcattaaaggaccaccttgaattcctggaaaaaccatagaattaattttttttgaaacttcagtattttttttacataaaataatacctcctcttggacctctaagagttttatgagtagttgaagtcacaacatctgcaatttcaacaggattaggataaagattagctgcaactaatcctgctatgtgagccatatctacaaaaaaatacgcattaatactatcagcaatttttcgaatttttttccaatttataatacgagaataagctgaaccccctgcaataatcattttgggtttgttttcataggcaagagattcaatttgggaataatcaattaatcctgtatcaatattgacgccatactgaatagaattaaaaattttaccagaaaaattaactgtacttccatgtgttaaatgtcctccatgatctagtttcatacctaaaattgtgtctccggtatttaatagagaaaaatatactgccgcattagcttgtgatccagaatgcggttgtacgtttacatattcggcagaataaattttcttcaaacgagcaatagctaaattttcaacaatatcaatatatttacatcctccataataacgtttattaggatatccttcagcatatttattagtcataactgaaccttgtgcttccataacttctaagcttacataattttcagaagctattaattcaagatatttttcttgtcttttttgttcattttgaattgcataaaaaatatctggatctgaaataaataaattttttttgaaaatcattaatataaatttttaattaaaaagctaaaaatattataatataattttagcattttttatatatatttattttgattaaaaattgacatattaaaaaaattaaatcagaatatgtagattcttgttttttttattaagtaaaaaaattggctgatactaaacaatcaaaaaagagaataaaacaatctgaaaaaaatagaaaaaaaaatgctagtgcactttctatgttacgaaaaaaaattaagtctgtaatttctgctatatctaataaaaataaagaaaacgcatttattgcatataaaaaaatggaaaaaatacttgataagttttcaagaaaaggccttatacattgtaataaatctgcacgttataaatctcgaatttttagaaaaattaaaaatttataaatctaatcataattttatattatttcgattttgtattattttttctacttttttttctaagacttctaatttttgacaagcggaaattaaaatttttttttgcatatcaaaattttcttttcctacaaaattcatattttctaaggtggaaaatacaatggattttatttttttttttaaaaatatatgcgttttttttattagaaacataaaataccttcagtataaaaattttttatttaaaaactttatttttttataatatataaatttattatataaacaactataaatttaattatatttttaatttttagaattatcttaattttagatttttataaaattatgttaacatttaaatgttattataaactttgatattctaaatatatttagttatggaagcagttaatttaaagtttgattttttaaaaatgtcttttcaagaaattcttgaaattattcaaaaatataaattatctattactgtaaaagaagcaaaaaaaatgcaaaccttatttcaaaaatttccatcactttctgaatgtattttatggggaattcatagatctgaacattgttcatataaaagttctcgtatttatttaaatactttacctaaaaaatctccaaatattttattaaaaaaaaatgaagacgcaggtattatctctattgcttatgcaaaagaaaataaagaatattatggcattgcaattagtcatgaatcgcataatcatccttcacaaattgttccctttgaaggagcggctacaggtattggaggcaatgttagagatgtttgttgtatgggggcaacagttattgctaatgcagatagtttacgttttggatctttgtataataataaaataaattcttcttggatatatgaaaatgttattaatggaatcgctagctacagtaatgcactaggagttcctaatatttttggagatgttcaatttgattctagatataacaataattgtctggtaacagcgataacaataggaatagttaaaaaaagtgaaattatacattcttatcttcctaaaaattcagaagattatgatataattttagtgggaaaaaaaacagatgccagtggttttggaggagcaactttttcttccattaatttaaaaaaaaatcaaaaagattgtagtgcagtgcaagagcccaatgcatttttaggaagaattttattgcaatctaattatgaattatttaaaaaaattgtatctttaaaaaagataaaagatgttgcttttaaagatttaggagcaggaggcattgcttgtgcaacttcagaattaattatagattcagaatatggagcagaaatttatatagataaagtacatgttctttctaaaaagattgatccaacaattatattatgttctgaaacacaagaacgttatatttgggcatgtccttcggaattaacttcaaaaatattacaacattacaatgaagaatttgaacttcccaaaatttctaatggagcttgtgcaagaattataggaaaaataaataaaaaaaaaaaatatcgtgtaaaatttaaaaatcatctactaattgacatagaagtaaaaaatttaaaaaaagaaattttttataataaaaatataaagaaaccaattttaaagtttacagaacctaaaatcctttctaaggatattgttaaaatttggattaagataatttctcatcctaatgtttctagtgatattgatatatttgaaagatatgataaacaagtacaaggtcgaacattaatagaacgaggaaatgcagattctggagtttttattccttttaatggaacagattttcctgaatctattagaaatattgctattgctttatcagtttctggaaatcctcgttttgggaaaattgatccttattgggcttctgtaaatgcagtaatttcgtccatgggttccattatttcagtaggtgcaacacctgaaggtattacagattgcttatgttttggaaaccctgaaaatcctgaaaatatgtatgaattggtaaattctataaaaggaattaaagatgtttgtgaaaatatacatcttttacgttatccttcttttccaactcctgttatttctggaaatgtttcccttcataatgtttttcaagaaaaagcaatacctgctagtccaattattagttgtataggaagaatagaaaattttaaaaaaactattaatagatcttttaaagaaataaataattttcttatattaattggagatcgaaaaaatgaatgtggaggttctatttattatgaagtttttgatgaattaggtaaaaatattccaaaaccagattttattcttatgcataaaatatttaaatggattcataaacaaatttctgataataatatactctctgctagttggattggaaatggtggtttagctgcaactttaactcgtatgagcattgctaatgaaattggattttcaattaaattaccaggaaaatataataaaaaaattgaacttttttcagaaacaccaggatttctacttgaaattcatttttctaaattaaaatttttagaaaattttgcaaaaaaaatgaatattccttttttcatattaggaaatactattcaagaaaaaaaatggtatatagaaaaaaatattaatattgatttgatatatgccaaaaaaatttggtttcattctttaaaaaaactacttttaacatcataatttatatatataaaaataatgaaagaaattacttataaagattcaggtgtaaatttaaaattaggaaattttacgatttctcgtattaaaccaattattcatagtacttttaacaataatgtaataagccatataggaactttttcttcgatatttgatttaaaaaatattttgaatatatataagcatcctttaatggtgcaaagtatggatggaataggaactaaatctattattgcaaaaatggcaaatcaattttataatttaggtatagatttagtgagcgcttgttccaatgatatcctaacattgggtgcaaaaacattaactttattagattatatttcaacttctaaattaaattcacatattgtagaagaaattgttaaaggtatggtagatgcatgtaaaaaggaaaatattgctcttgtaggtggagaactagcagaaatgccgggtatatatattaaaggagaatacgatatagtaggcattgcaactggaattatagaaaaagaaaaaattataaatggaaatcaaatccaaattggagataaaattataggttttttatctaatggattacatactaacggtttttctcttgcaagaaagttattgtttgatatcaaaaaatttcgtattcatcaatatataaaaaaattaggtaaaactttggatgaagtattgctagaacctcatataaattattcaaaattaatacataaaatattaaaaaaagaaatttttattaaaggcatggctcatattactggaggaggaataattgaaaatatccctcgaattttaccctttggctgtggagcagaaattaaaattcattcctggcctataccaccaattttttcttttttatgtcaaattggaaatttatccaaaaaagaatcttattccacatttaatatgggaattggttggataataattttatcaaaaaaatcattagcacaattaaaaaaaaaatgtaaagatatttcttattttgttataggaaaagtaatacaagataaacataataaaatatatttaaaagagattttataatatgaaaaaaattggagttattcaatttcctgggtctaattgtgaacgtgaaacgaaacttgctatagaacgatctggaatgcaagcaatctcatttttatggaattacaaaactgtttcttttgatattttcgatggttttgttattgttggaggattttcatatgaagatcgttgtcgttctggattaattgcttctaaagatccattactttctaagcttatcatagaaatagaaaaaggcaaacctgttttaggaatatgcaatggagctcaaattttaatagaaagcggaatagttccaggtataaaaatacaagattcttataaattatcagttgctttgacacttaatgaaaaaataaataaaaaaggaaaaatcttaggaataggtttttataatacatggtgttatatagatattaaaaatcaaaaaaatatagcagaaaatgcattttttcaaaaaaaattttcaaaacctataagaattccatttgcaaatgcagaaggtcgttttattttaaaaaaatctacttttaatttattaaaatcctcaggtgttatggtatggaaatatgttaatagtattggaaatataaaaagatattatcctataaatccaaatcaatctatggaaaatattgcagcaatttcaaatttttctggtaatgtattagcaatgatgccacatccagaaagaacaactgatggtgatattatttttgcatctattcgtacatatcttgaaaagaagaaaatatttttatataaaacttttaaagaaaaaaaaaaaataaaacaattaaaaaattatacacttcctgaatcaagatatcaatttttaataaaaatgattattacagataatgaatctatttctatagaacaaacattgaaaaatttaggaatttattgtacaatacaaaaatatcaacatttagaaatattttctaaaaaaatagattataaaaaaatgtatgaattattatataataatcatgcattttataatccaaaaaaagaatatttaattacaaaaattaaacttcttaaaaaatctataaaaatattggtacgtaaaaatactgtatttaatcaatataagttaaatatattgcacaaaaaatattctttaaatgaaatttttgatattaaatatggtatattttggaatattatcccaaaaaattatcaagaaattgattatattaagaagtatttacttcataattctatattatataatcctatagcatataaagcatatttttatgaagaataattataaattttatattaaagaaaaaataccattcgtggtatcgaaaactaatttaccatatccaaaatttcaaggaaaaacaagagatgtttatgatttaggagataatacattactaattattaatacagataggattagtgcttttgattcaaatatatcaaatattccatttaaaggtaaaataataaatcaaattagttcttggtggtttgaaaaaactaaaaatataattcctaatcatatgatttctatatcatcgttgaatgaaatgagagttaaaaaatgtaaagtttttccaattgaaattgtagtgagaggatttattactggcaatactaaaacttcactatggaatttatatcaatctggcgttcgtaatattttaggtaaaaaattgccaaacaagttaatcaaaaatggaaaattaccatttcctattatcactcctactacaaaatctcatatatctgataaaccattattaaatattaaagatattattaaaaataattttccttctgaagaacaatggaattttatttctaaaaaatctatagaattatttttatttggtcaaaaaattgcaagaaaatctcatttattattagtagacactaaatacgaatttggtatagataatcaaaacaatattattttggttgatgaatgtcatacacctgattctagtcggtattggaaattcaaagactatcaaaagcattttcaaaaaggtaaagaaataaaaaattttgataaagaatttttaagaaaatggtatatcaaacaaattaacccttatcaagaaaaaaaaatacttgacattcctgaagaaattaaaattgaaattagttatcgatatattcaactttttgaaaagttaactggaaaatcttttttttagaataaaaaaatataatttttttacgcaagtattttcaagatgggtgaatattatataatataaagaaaataaataaaaatggtagggaaattaccattatgtgcggtattgtaggaattatttctcaaaacccagttgcttttgatttatatgatagtttaatacatttacaacatagaggacaaaattcagcggggattatgacatgcaataattatttttatagtcatataaaaaaaggattagtacaagaaatttttaataaaaagattcttaataaattatctggtaatactggaatcgctcatgttcgatatccaacttctggaaatttaaatgaaaatgaatcacaaccgtttaggcttagtactccatatggtattagtttagcacataatggaaatctagtaaatcgattgcaattaactaaatttttaaaaaataaatgtttgcgacatttaaatactgatagtgattcagaatgtttgattcatttattagctaacagtcttattaagaagactgttaaaaataatagcgataattttttcaaaaaattatgtgatgggattaaaattatacataaatatgtagaaggatcttattctgtagtatctaatataataggcaagggactaatagcttttcgagatcctaaaggaattcgcccattagtaatgggtattcgaaaaaacaatatgaataataaaaataaatatgatgtaattttttcttctgaaaattcatctttttttagtttaggatttaataaaattgacgatgttaaaccaggtgaaataatatttgtaaatttttcaggaaaaatttttcgaaaaattttaagtaaagaaaaatttcaaccatgtatttttgaatacgtatattttgcaagacctgatagtaaattggatgatgttagtgtttatcgtgcacgtttacgtatggggcaaaatcttgctataaattggcgaaatacttatcctaaattaattcctgatattgtaattccagttccttttacttcaaatactgcagctctttctttcgctaatgaaatgaaagttcgttatagtgaaggattatataaaaatccatttattggaagaacttttatcatgtcagaaaataaattacgaaaacgttcagttatttataaaattagtccccaacctaccgaaattcgtggaaaatctgttatgcttatagatgatagtatagtaagagggacaacaagtcgagaaatagtgaatatgattcgagaatgtggcgctagtaaagtattttttgcaagctgttgtcctccattgaaatatccttgtttttatggtatagatataccaacatatgaggaattaattgcaagcaataaatcatttcatgaaattaaaaaatacatgaatgtagatgcgcttctttatcaaaaggaagaagatttagtagaagctattgatagaagggggaaatatcatattgattcgccatgtatggcatgtttaaatggaaaatatatatgcaaaaaaaaatcaaaggatttaaataatgcaattaaataatatgtttgggaaagatattatttctattgcgaatatggatgtacatacaatacaattaattttaaaaactgctaaaaattttaaattatttccaagaaattcttatttaaaaaataaaatcataggaagctgtttttttgaagcatccacaagaacacgtttatcttttgatacagctatttatcgtatggaagggaaaattattggtttttcagatattgatacaacatctgctgggaaaaaaggagaaagtctatctgatacaattcaagttattagcagttatactgacgctattattattcgtcatccttgtgcaggatctgcaaaattagcagctgatatttcttcaaaacctgttattaatgctggagatggaggtaatcaacaccccacacaaacattattagatttatttacaatttctgaatcccaaggatctttagaagaacttaatattgccatggttggtgatcttcgatatggtagaacagttcattcattatcacaagctttatcccattttaatactactttattttttgttgctcctaaatcattatctatgccagatagtgtttgtaattttttaaatgaaaaaaatattaaattttcatatcatgaaaatatgatggaaatattatctgatcttgatattttatatatgacaagattgcaaaaagaaagatttgaaccaactgaatatcatgaaataaaacaacaatttattttaaaacctcatatgttaatgaacactaaaaaaaacctcaaaattatgcatccattacctcgtgttggtgaaattgataaaaatatagatattatgaaacaagcatattatttccaacaagcttctaatggtgtagaaataagacaagcaattattgctcttttactaaaagaaattttatgaataattatacaattttatcagttacagcaataaaacaaggatgtgttattgatcatattaccgcaggacaaggaattaaaattttacaagcattagatcttttaaaattaaaatatcaaattacggttggattaaacttgccaagtaaaagaaaagtattaaaagatcttattaagattacaaatttttatattttaaatgctacaatatcaaaaattggtattattgcacctggttctactataaatgaaattaaaaattacaaagtaaaaaaaaagtacatgttaaaattacccaacatagtcaaaggattgtttatttgtcctaatacacaatgtattacacaaacagaatcattagaaagttatttttatgtcttatttaaaaaaaaagaaaaagacgttaaactgatatgccgatattgcgaaacattttttgataaaaatattttagaaaatattcattattagtttaatatttatttttttttactctaaaaaatctgataaaataatatatttagttaaggtttttaatttatgattattaggtattaagtttaaattttttaaagcacaattaaaatgatttttaatataaaaaattgattttttaattcctaatattttaggatatgtgtttttagatatattttgattatcttttaaactatcaataatatcatcttgaatttgaaaagctaaagcaatatgataagaaaatttatcaaatgcttttttatattttttatctaatttattctttttaagataccctatttttacactagcttttattaaatttccagttttaaaattatatataatatctaatttttttttatttttatattttaatgaaacaaaattattaatatctaaatattgtcccaaaaccattccttttataccaattgctttagatagtgtatgaattatttgaatttttttatgatcagatatgcctggattagaatcacttaatatttcaaaggctaaagaatgcaatgaatctccagctaaaatcgctgtagattcatcgaaggcaatatgacaagaatccctaccacgtcttttcatatcgttatccatagatggtaaatcatcatgtattaaagaatatgcatgtatcatttctatagcacaagctgaaatatcacaatgttctataggtatcccaattgatgttgcagttgcataatccaataatcctcgtattttttttccatttaataaaatataacttatcgcatttaaaagaatatgattctttttgttaattttttttgaatttagtattcttattaaagtattttgtatacgtgacaaacattcattaaaaaatggattatcaatttctttttttgaattaattagagaatcatacattagattatattttttcaaaattgttaactctatttttttttagaaaaaaaattctttactcctttgaaccaagaaaaagaacgtggggtatattttgtattattatgtaatgtagatccaaaattttttaaaatttttaattgatctttatccaaatttattggtgtttctatacttactttacatagtaaatctccaattctattccctcgaaattcttttacaccttttcctcttaatcgaaataattttcctgtttgtgtttcttttggaatttttaattttatcttaccatccatagttggtacttcaattattccacctatacaagcaataacaaaatttaatggtacttcacatattaagtcattgccccttcgtttaaataaatgatgggatttaatttgaatttgtacatacaaatctcccgaaggacttccttgaggcccatgttctccttctcctacaagacgaatttgatcgccttcatcgataccaggtggaatctttacagataattttttgtatctttgtatgcgtccttttccataacataatgtacaaggatattttattactttgccttgtccatgacaatctggacaagtttgttgtactgaaaaaaatccttgttgcatacgtatattgccttgtccatgacaagttgcacaatttatttttgaatatccttttttagatcctgaacccttacatatttgacataatactaatcttggtatattaatttgagttataacaccatgaatcgcttcttctaaattaatttgaattgtatattttaaatcagatcctttttgatagcttctttttctagaatgagaatgttcattaaaaatatctccaaaaatatctccaaaaacttcattaaaagtattgccagaattaaaactagaatagcttgtatcaacaccagaatgtccaaattgatcatatgctgcacgttttttagaatcactaagtatttcataggcttgattagcttctttaaatttttcttcagcttcagtatcaccaggatttttatccggatgatacttcatagctaatcttctatatgctctttttaattccgtattagaagcatttttttttactcctaatacttcatagtaatctttctgattactcatattgctcctttaattataataaatttttacttcttttcattatctttaacttcttcaaattctgcgtctactatatcctcatttgaagattttttttctttttcttgagtagaagaagatgatgatgaattagtatttatgttttcttttttatatattgcttcagttaatttgctagcatattgtgttagtattttagttttttcttcaatatctgttttattatcagtttttaaagatttttctaattcgttacaagcaatttcaattttatttttttcatcggaagaaattttatctcctatttctttaatagattttcgagtagtatgtaaaagattatcgccttgattacgtactaatacaagtttatgaaattccttatcttttgcagaatttgattctgcgtccttcaacattttttctatttcattttcagaaagcccaccactagcacgaataacaatagattgtttttttccagtagctttatcttttgcatgtacatttaaaattccatttgcatcaatatcaaatgttacttcaatttgaggaactcctcgtggagctggaggtattccagttaaatcaaaacgtccaagtgatttattagaacttgcaatttcacgttctccttgcaatacatgaattgttacagcattttgattgtcatctgctgtggaaaaaacttgagattttttagttggaattgtagtgtttctttcaattaatttagtcataactcctcccatagtttcaatacctaaggacaaaggcgttacatctaataataatacatctttaacatctccagataaaacccctccttgaattgctgcgcccatcgctacagcttcatcaggatttacatctcttctaggttttttttgaaagaattctttaacaatttcttgtactttaggcattcttgtttgtcctccaacaagtattacatcagtaatatcttgtatcgtacgatctgcatcttttaatgcttttctgcaaggttcaatagttctatgaattaaatcttctactagagaatttaattttgcccgagtaacttttaaatttaaatgcttaggtccagaagaatctgctgtaatataaggaagatttatatctgtttgttcattagaagataattcaatttttgcggtttcagatgcttcttttaaacgttgtaatgctaaaggatcttgctttaaatttataccatgagatatcttaaattcatttactatataattcattagacgcaaatcaaaatcttctcctcctaaaaaggtatcaccattagtagctaaaacttcaatttgactatctccttcaatttttgctatttctataatagaaatatcaaaagttccaccacctaaatcatatactgctacaattgaatcttttttacccttatctataccatatgctaaagcggcagcagttggttcattaataattctttttacatttaaacctgcaattctacctgcatctttagttgcttgtctttgtgcatcatcaaaatatgcgggaacagtaattactgcttcagaaatttcatatcccaaataatcttctgctgtttttttcattttttttaaaacttctgcagaaatttgaggaggtgcttgttttttttcattaaatataatccaagcatcgccattattagctttaactacttgaaatggaacttttggtaatatttctttttgtataatatctccatcaaattttctaccaataagacgtttagctgcaaatatagtatttttaggatttgttaaactttgacgttttgctggatctccaacaattatttttccttctttatctatcgctacaatagatggtgtagtacgacgtccttctgaattttcaattactttagcactttttccgtccataacagagacacaagaatttgtagtgcctaaatcaattccaataatttttcccattgttttctccaaatatataaaaaatttaaattttataatttttaaattttattcaagttatttcattttttatttattcacaactacacgtgcaggtcttagcaatctgccatgcagaatatatccaatttgatacacttttacgacagtattagattcatattttggatttttaattatcgacatagcttcatgaaaatttggactaaaacattcacctattggattaatttgcgaaattccaaatttattcattatatctataaatattttcatagttaatttaataccatcatgaattacagatatttcagatttttttgaagataattctaacgttttttctaaactatcaattattggtaataaactatttgcaaattttgcaatagaaaatttatgagatttttctaaatctatacttgttctttttcgaatattctcaacttcagcaaatgcacgtaatgcttgatctcgatattttttgtatttttcttcaaattttatattctttaaacaagatacttctaattctttttgtaattctttaattttctgtgcatgtatattttctttagcagatgtatctaaacaattttctgatatctttttagaatgtaaatctttagatataatcttttctgacattaaatattcccaaaatttctaacatgaaagaatgtggggatatactagaaaatttcaagttttaagagataaagaataataaaaaatgtttatattctatatttttagaaatactattttttttaaaaaaaattgtattattccttaacaaggtaagattaaatatctagttcttgtaaattaatatttaacatatttttttttataaaatcttttcgtagttcaatatgatttcccattaaagtataaaataaatgatctgcttgactattatttttaatatttacctttaaaatatttctagtttttggattcatagtagtttcccataattgatgagaattcatttcacccaatcctttataacgttgaatatattttccttttcgagattcttgtaataaccaatcaatagtattataaaaatttttaataggatatttttgatttttatattgtatatatgataaatctttttttataaatttatttaaaatcattccttgttctatcaaccattgatattcaaatgaatcaaaaaaatttgcatatattggaaatttttgatgaaaaccattttctataactttaattatgggaataaatgtttctttcatttcacattctttaatataacaaaaatattttttacctaaatgagattttttattcaaattagattccaatgcataaaaaatattttccaaatattttttctccataaaatctgtagatgaaatttttttaaaatacattaaagattctaaaatttctttaggataattcttagaaagcttttttattattctttcagttttttttgtttttaaaattaatcgttctaattctaaaccttgaataatttttttttctttttctataaaagttattagcttagttttttctattgcaatacctattaagtatttaaataaatcattattgtctttaatatatttttcttttctttctccttttatcctatacaaaggaggacgggcaatataaatatatcctctttctaaaacatctttcatttgtcgataaaaaaatgttaataataatgttcttatatgtgatccatctatatctgcatcggtcataataataattttatgatatcgaattttattaggatcatatttattttttccaatactacaacctaatgcagtaattaaatcaccaatttctgatgaattaatcattttatcaaaacttgctttttctatatttagaatttttcctttaattggcaaaatggcttggtttcgtctatcacgagcttgtttagctgatccaccagcagaatctccttcaacaataaaaatttcagaagattcaggatttttttcttgacaatcagataattttcctgaaagtccagctatttcaatagtattttgcttttttgcaatttctctaattttacgtgctgcttctctaatacgtgcagtatgaactattttttcagatataatttttccttctctaggattttcttctaaaaattcaaataatttttgcgaaactaatgaatcaataattgtttttgtttcagaagatataagtttatttttggtttgtgatgaaaattttggatcttgaattttaattgataaaatagcagttaaaccaactcgcgtatcttctccaatagttactattttatcttttcttaaaattttttctttttctatataattattgagagttcgagttaacgctgttttaaaacctgataaatgcgaaccaccatatttttggggaatattatttgtataacataaaattttttcttctaatgaatcacaccattgcatagcaagttccattattaatttattttttttttcatgtacataaaaaatctttttatgaatagtgtcttttccaatatttaaatatcgaatataagaagaaatgcctcctgcataaaaaaatgtttgtctttgattatcacgtttatcttcaatatcaagtcgaatgccagaatttaaaaaagctaattctctaagtctttttgatactatagaaaaatcaaaggttaaaatatttttaaaaaaattatattcaggtttaaaatatatttttgttccatgtttttttgtttttcctattttttttaaaggaaattcaggatatcctaaatgataaatttgatgatatatatatccatctctatatatagttaaatcaaaaatttcagataaagcattaactactgaaattcctactccatgtaatcctcctgaaattttatatgaactatcatcaaatttagcaccagaatgcaacatggttaaaataacttctgccgcagattttttctcttcaaaatgtatatctgtaggaatgcctctaccattatctataatagatacaaaaccgttattatgtaatatcacagaaatcgaatcacagtatccagctaaagcttcatcaatagaattatcaatgatttcaaataacatatgatgcaaaccagttccattatcagtatcacctatatacatgccaggacgttttcgtacagcatctaatccttttaatacttttatatttgcagaagtatagttattgtttttattttttaaggattctttattaataatattattcattataatcctatctaaggatatcaaaaagaatttttattttaacagaagaaaaaaaaaactccaataactataatttaattggcataataatatatatattatttatattttttttatcttttataagaacactatgataagaatctgtgaataaaatttgtattgtatcattttctattacatttaatacatctaataaataatttatattaaatccaatctctattgattttccttgatatagaatctttaatttatctttagctatttcttgttctaaattctttgcaaataaagataaactattattgctaatatacatacgtacagatttatatttttgatcagaaagtatactaattctattgagtgatgacttaattaaatcagattcaaccgttaatatatttttaaaatctgcagaaataatagaattataatcaggataatttccttctattaattttgaagttagactataattagcagtttctattttaaaatggttttcgctgcaaaaaatattaatttctgatttttctttgtgtattaatctaataatttctaaaacagtttttcggggaataataattttctttttatttttttcattattttttataaaaatacttgacacagccattctatgaccatcagtagcaatagaccgaatataattattgcctatttcaaatagcaagccatttaaaaaataacgaacatctttcttagccatagaaaaatatgtttttttaaataaaaataaaattagatgggaagatattttaagaatttgtattgtttttatatttttcatatttggaaattctttaataggtgtagtacataatttaaaagatgtttgattcgatataatgattccctgatttttatttttatctaaaataaatattatttctgatttttctgttaaattcttacaaatatctaataattttttagcagacaaagtagtacttccatcttttccagaaagaacaactattttggttgctatttcaatttcaaaatctgttgcagttataaaaaggatattattttttaattgaataaaaacattcattgctatagctatggtatttcttttgctaataacaccaataatagtttgaagtccttttaaaaaggaatctctttgaattttaaattccattacaaaattttccttaaacttaatgtattttatgtaaaatatatattttaaatttatacatctataattcaaatattatagaatcttaattttaaataaatattgaaaaattatttaatataaattttttgaagtaaattcaaatagaatttgacttggttaaatcacttagataagctgttttgtatttattcaatcgtataataatgaaaagaacatttcaaccaagcaatcttagacgaaaaagaaatcatggatttagagcaagaatgtcaacaaaaaatggaagattaattttaaatcgtagaagagcaaaaggcagaaaaattctatctgcatgaaaaatatcaacctactaatgtcatataaattttctagaagaaatcgattaaaaaaaaaacaatattttcaattatttaataaaataaataataaatatatagataagtatatgatatttatatatcaatatacaaaagatattagtcagcttggattaataataaaaaaaaaatatgttccttcttccgtatgcagaaatttttataaaagattagttcgagaatattttagattacataaagataaaataaaattaaaagtaattatcatagcaaaaaaaaatttatataaatgtaataaatgggaaataaaaaaatgtttgcaaaaattttggcaatattgtatgagtatgcagacactagaatagtgtttatattttttattcgaatatatcgtttatggagtattttcagctatccaagatgtcgattttatccatcttgctcaaaatacgcaattgatgcttttcaaaattatactgtattatattctttgtatttaatttttagacgtttaatgaaatgtcatccatttttttggggagagttgtatgatccaattccttctgaaaaaaaaataaagtaattttaaatttatttattaaggtgtaatttagctggtgaatattagatttatacgaaacattttattaattttgctttttcttatattatcaattatatattatctttggcaatcttttgatgatacaattgtaaaaaaaaaatatattttaagcaaaaatataacagaaaattctaaacaaaaaaaagaatatttaacaaaaaaatataataatacagattattttcaatatcccaaaattaggattaaaacggatgtattagatattaatttaaatttgttaaatggaaatatatcatatgctgctttattaaaatatccgaataaacttcattcaaaaaatccgatagtattattagataataaaggaaataagtatatagcagaaagtggaatttatagtgaaaaaattccagaaaaaattatatttaatacaaaaaataataaaaatttttataaattaataccaaaagaaaaacaattaaaggttaatctttactggaaaaaaaataaaatttctataataaaggaatatatttttactagaggtaaatatgatataatagttaattatatcattaaaaatgatacacaaaaaccttttacagtaaaattttataatcaattggtaagaaaaattccagataaaaaaaagaattttttcttttcatattcaaatgatatggaaacagctatttccacttctaatgaacattttcaaaaaattacgtttaaagaaatatcaaaaaaaaatttaaatcttatatcaaaaggcggatggattgccatgattcaacactattttattagtgcatggataccaaatacaaaacaagaaaatctattttatacaaaagatttaggaaataatatttattgtattggattagaaaattcaaaaaatactgtatattctaattcaaaaatttttaatttttctaaaatttatataggcccagcaaaatcagattatttagcttctgttgctcctcatttagaattaactataaattatggttttttatggtttatatcattattaatatttcatacaatgagttggatatacaatattgtcgggaattggggttggtctattgttttagttacattattaattaaattaatattttatcctctttctgcaaaaagttatcgtgctatggcaaaaatgcgtaatttgcaaccaaaaatacaaggtttaaaggatcgtctagcaaatgataaaaaagcattagggcaagctataatagaactctataaaaaagaaaaagtaaatcctttaggaggatgtttgcctatattaatacaaattccagtatttattggattatattatatgttagtttatagtgttgaacttaggcaagcaccatgggcattttggatacatgatttatctgtaaaagacccttattatattttacctattattatgggtataagtatgttaatacaacaaaaaatgaatccttcaaattctgtggattctttgcaagaaaaaatattattaataattcctattgtatttacattaatgtttttaagtatgccatctggtttaattatttattggacagttaataacttcgtaactattttacaacaatggtatataataaataatatcaataataaatctaatgttgcaaaatgatacaattgtagctattgctacagctcctggcagaggtggaatcggtataattagaatatctggaaataatgttttgtctatttctaaaatattattaaaattttatccaaaaaatagatatgctcatttttgtaaattttatgatcaaaaaaataatatcattgatgaaggaatagctttatatttttctaaaccaaattcttttacgggggaacatattctagaattgcatgcacatagtaatccaattattttagataaattaattgcaataatcataaatactaaattagcaagaattgcaaatccaggagaatttactgaacgtgcatttttaaacaataaaatagatttaactcaggcagaagcaataatagatttaattaatgctaattcagaacaagcaacaaaatcagctttatattctatgcaaggcgaattttctaaaaaaattaatattttattacaaaatttaattaatttacgaatgcatgtagaatcatcaattgatttttctgaggaagatattgattttatagaaaatcctaaaattattgaaaaattggatttttttattcaaaaaattgaagaaattttatctcaatctaaaacaggtattcttttaaaagaaggtttatatttatctattataggcaaacctaatgcaggaaaatctagtttattaaatgctttatcaggaagagaatcttctattgttacaaaaatagaagggacaactagagatattataagagaaaacattcttattaaaggcatacctattcatattgttgataccgctggaattagagattccaataatcttattgaaaaaaaaggaatccaaaaagcgcttatagaaataaaaaaatcaaatcatattttattagttatagatattcaaaaagaaagaaatcatcaaaaatctattgatgaaatatgttctctaattcctcataacatacctataactattatacttaataaatgtgatctattgaatttaaagcctaaatttatcaaaattagaaataaagaaggattaattttttcaactaaaaaaaatgtaagtcttgaaatgcttagaaagcatttattaaaaactgtcggatataatcaaacggtagaaggaaattttcttgctagacgtagacatattttagccttagaaaatgtaaaaaataaattattaaaaagtaaaaaaaaatttctttataatccttctatagatcttcttgcagaagatttacgaaaatcccaagattattttaatgaaattcttggaaaatttacttcggatgatttattaaaaaaaattttttctgaattttgtattggaaaataataatatataaagaaatattacttttttattttaaatattttagtaaaattactatttaattattatataaatataggcaattatgtctataaaaaaatactttgatgttattgttattggtggaggacacgcaggaacagaagcatctatagcttcagcaaaattagggtctaatactttattaattacacagaatattgatacgatagggcaaatgtcttgtaatccagcaattggaggaataggaaaaggtcatttagttaaagaaattgatgcgcttggaggagtaatggggatagctattgatttttcaggaattcaatttagaattctaaattctagaaaaggttctgctcttagagcaactcgggctcaatcagatagattttggtataaatataaaattcgttctatattagataatcaaaataatcttaaaattttacaacaagaagtagaagatattattttaaataaaactaaagaaaaaattttaggagttattactaaaatgggtttaaaattctattcatcatcagtagttttaacaaccggaacatttttaggtggaaaaatttgcattggaaataaacaatatataggtggaagatttggagatgcagcttctaatatcctttccaaaaaacttagaaaaatgccatttaagattggaagattaaaaacaggaacaccgcctcgtatagatgggaagactattaatttttctgtaatggaaaaacaaaaagaaagtgttaaaaatgctcatttttcatttattaacaatggatattataatttaaaacaaatatcttgttatattacttatactaatgaaaatacccataaaatcataaaagaaaatttacattattcttcaatatattcaggaaatattatagggaatggaccaagatattgtccttctattgaagacaaaatagttcgatttaaagataaattatatcatcaaatttttatcgaaccagaaggaattaatacaacagaaatatatcctaatgggatttctacaagtttgccatgttcagtacaaaatgattttatacattctattaaaggattagaaaatgcacatattattcgatatggatatgcaattgaatatgatttttttgacccaaggggtttgcatcattatttagaaacaaaatgtataaaaggtttattttttgcaggacaaattaatggtacaacaggatatgaagaagcagctgcacaaggtttaattgctggtattaatgcttcacgattatcaaaaaataatagtttttggtttcctaaaaggaatcaagcgtatataggagttttaatagatgatttagtcacgttaggcacaaaagaaccatatagaatgtttacatctcgcgcggaatatagattatttttgagagaagacaatgctgatgatagacttacaccaattggaaaaaaattaggattagtcgataaaaagagatgggaaatttttcaaaaaaatcataatattcttatatatgaaaaaaatagattaaaaaaaacatttattcataaaaatactctacaagaaaaaaaaatatctagttttattaaaaataaaatacaacatgaatatagtttagaggaacttattaaacgtcctgaaatagattattctattcttatgtctttgaaaggacttggtcctggaattaaaaatttaaaattaatagaaaaaattaattcttctataaaatatgcaggatatattgctagacaaaatatagatattgcaaaagttaaacataatgaaagtatttgtataccaaaaaatatcaattataaaaaaataaaaggtttatccaatgaagttatagaaaaattaaatattattatgcctaaaacaataagacaagctatgcgaatttctggaattacaccagtggctatttcaatattattaatatatattaaaaaattaaattctaaatgatattgattatcatttatattaacgttatactttgtaataattataaaacaatatatttatgattattaagttatgttttttaaaaaatcatctattttttctattgggaaaatatatcgtattaaaggattttctaatagttgtaatagttcttatcgtcgtaaatttttttcattaggttttattcctaattcaacttttgaaatactatgtatagcaccttttggtgatccaattcaaattcaaataaaaaaattattactttctttaagattaaaagaatgtaaatatcttgttttagaagaggtaagatttttaaatgaatataattagtattattggaaatccaaatactggaaaaaccactttatttaatatgcttactggaaaaaatgaacgtgtaggaaattggtctggtgtaacagttgaaaaaaaaactggagtttctataattaattctaaattatataaaattattgatttacctggattaaattctttcagttcaaatacaaaacatatatctattgatgaacaaatcacttgtaaacatttattagataataaatttgatattattattaatattattgatttctcacatttagaaaataatttatatcttagcactcaattattagaagctaatatacctatgataatagtgattaatatgcacaatatagtcatggatcttaatgtagaagatataaaaaaaatatctaaattaacaaaatgtccagttgttattatgtcttctaataaaaaacatagtattgatttgattaaaaaaaatattcaaaaacttattaatcaaaaaaaatataaaatatatagaacagaatatagtattaaattcaatttaataataaaaaaaatatatcagtatttgaaaaatgattttttattaaaagataaaaatataaattattattggataatatttcgttttcttgaaaaagatcaattaattagaaaaatattaaaattagaagaaaaaacaatattgaaaatagatcatgctatttccaaattagaaaaatctttagaaacagaatcagatttttatttagcaaatcaacggcataaaaaaacctataattggattcaacaaacaaaaaaattaaaagataataaaaaacatttttttataacaaaaaaaatagatacaattataattaatcgatggataggaattccagtatttctattaattatgtatctaatttttcaatgtacaatatcttttggtggagcttttcaacctatttttgatacaatttcacggataatttttgttcaaggaatagaaaatattggacatactataggattacctatttggataattactatattttcaagaggaattggattgggactgaatacagtaataacttttattccacaaattagtattttattttttatgttatcattcttagaaaattcagggtacataacaagagcagcatttgttatggataaaataatgcaattagtcggattaacaggaaaaacatttcttcctttaattataggatttgggtgcaatgttcctggaattatagcgacacgttctttggaaagcaaaaaagatcgtttactttcaatttttatttcgccttttatgtcttgtactgcaagattgtcaatctttgcaatattttcaacagcattttttcataaaaacgcaccatttataatattttcattatactttcttggtatttttattgctttattaacattaataatattaaaattaacttttttaaaagctcaagaaattccttttatattagatttaccattatatagatttcctaacattaaacatttatttttagattcttttgttcggttaaaaaattttttgtttggagcaggaaaaacaattattccaatatgtatgcttattggtctattaaatagtttccaatggaatggaagggttgttccagaagaaaaagtttcttcttcaatattatctgatattggcaaaacaattacaccgatattttatccaataggaatttcatataaaaattggcctgcaactgttgggttaataacaggaatattagcaaaagaagtggtaataggaactctcaatactttatatacttctaacaatatgaatattgctctatcaatttatgataaaaataaaacaaaggaaaaaaaatatatatcaaattttcaatttgaaatatttcatgctttaaaagaaaccaaaaataatatcattgctcttattccctttatatctagtaattctattttatcatcagatgaaaattatatttctaatacagctataggaaatatgattactttttttaaaacacctttagctagctatagttatatgatatttatattgttatatgttccatgtatatcaacaatagctacaataaggagagaagttaattttgtatggagcatattatcattaacatggagtttagttattgcttattctgtatcggtaattttttatcaattattttctattaaagaacatattgcaattagtgtgtattggataatatctatgttgatatttttaacctttattatttttataataaaaaaaattgcaaataattatattaatgctagtaaattaaatattaatagcgaaatcttaaattgtaaaaatagtaaaaaatgtaagaattgtcataaaaattttgttataagatctatataatattagattttttagaaaactttaaagatatataacctagcatacttgcaaaaattgaagcaaataaaatacttaactttgctattgccagtttttctatattatcaaatgataattctgatataaaaattgatatagtaaaaccaattccagaaattattccaattgaaaaaaaatcttgtttttttaaatcaaaaggcattgtaattattttaaaataattcccaatataattactaataaatattcctaaagtttttcctaaacagagaccgaaaaatatacctaatcctataggatttatcatgcatttgtatatatttatattggaaaactttatagatgcatttaaaaatgcaaacataggaactataaatatataaactggtatgcgtaatattttttccagtttgtacaaaggattaatatattttcttgctttttttatttgtttttttatacttccaggtattgtcaaacctattaaaattcctgtaatagcagaatgtataccagattttaaaagaaaataccataaaaatatccctataaatatatatattgataatttataaatctttattttatttaaaatgattaaaataaaaaaagataaaaaagaataaataatataattaatcaatatatgatcattatttttataaaataatgtgatcacaataatacttcctatatcatctataattgcaattgtagataacataagaaatatatttttagaaatattttttccatataaagataatatactaatagaaaaagcaatatctgttgctataggtatagcccaacctttaatattttctgtattataattaaatattatataaattaaagctggaattatcatgcctccgattccaacaaatattggtaaaattgcttgattaaaagtattaaattttcctgtaataatctctttttttatctcaagtccaattaataaaaaaaatatagtcattaaaccatcgtttacccaatattgaacagatttctttaataagaaaattgaaaaaaaagagatagaaatattaaaatttttaaaagcaacataataatgtgaataattactgtttattaaaattaatgaaattaaggtgcaaaaaataagaagtataccactaagaatttgtaatgatttttttttttgtaaaaaattaatatattttatcataataaagataattttgaaaaatctataatatgtaagaaaagattttttatattttttaataacattaaacgattatttcgaatttttttttcttgagacaaaattgtcacttcattaaaaaaattattaataggaataactaattccataaaagcatgatatattgataaataatctttttctttttttttttttaatagaaatatagaaatttcttgtatttttttaaataaaatcttttcagattttttagaaaaaaaatctggtattacttttgtaaaagtttcaggtatatatttttttttcaatatattttggatacgtttattaatatttattaatataagagcagaatctctataagaagttataaatgtataactatcttgtatatgataatgaatatttaatggtttttcttttttagttaaagaaataattgaatttactaaattaacagaaatgccattccttttgtaataagaatttaatctatgaaaagagaaatctattagttgattgacaatcatatttttctttatattatataattgcagagatcttttaaagattttttttaaatttaattgcaacttcccttcaataatggttcttaaaataccaatagataatctacggagcgaaaaaggatctttacttcctgtaattttattttgaatagaaaatattcctacaaaagtatcaatcttatcaccaattgctattattttgcctaatatggaagatgctattttatcatttgaaaaacgtggaaaataatgttcagagattgctaatccaatttcttttttgccttgaaaataatatttgctcataataccttgtaattgcgggaattctctcactatattagtcattaaatctgatttgcataataatcctgctatttttgcatattcagaattatattgtattttttgagatatatattgactaagatatgaaacacgattaactttatctaataaagttcctaattgattttgaaaaattattttatctaactgaggaagataatgttctaatgaattttttgtatcgcctttataagaaaaagatgcatcctgtaatctagcatgcattaccttttgattaccatttattacgcaagataaattagattttgctatatttgtaataacaataaaattaggcataaaatttccatttatattacgcaatggtatgcatttctgatgtgtctgtattacagaaattaatatttcttcaggaatttttaaaaattttttatcaaaattacataatatagcccttggccattcaacaatatttgtaatttctgttaataattttctcgaaattaaagatttactatgtagttttttttcataaaatttaattgcatttaaaataatattttttctttcaaaataatcaggaataacaaaagatttttttaatttttcttcatattgatctatattgattttcaaaggtttattattaatataatgatgaccatatgtataggaattgctagaaattccaaaaagacaaattggaattactttgtcatttagcaatacaactatccaatgtactggacgtataaataaatattctttatttccccatttcatcattttaattgatgaaaaaccttttaaactatatctaataaaattagatattttatttttatctaaatctatttttaaaggattttctattttttttatgagaaatccaaatcttcttgaagaagaaataatttttactaatttaaaaataaaattattactttttagtttttttaaaaaattattggtaaatttttgagaaatagaatttaaagattttggtggtaattcttcagttccaatttctattaataaagattttttactcattttacattctctaccttattacataaagggaaacccataacttttctttcttgaaaataagatttggcaataattttagataaatattgtaaacgcaaaataaagtttttacgttcatttactgaaattgcatttcgagcatctaataaattaaaaatttgagatgcttttaaaagcatttcataacttggtattgataattttttatttaataaataattacattcattttcataaaaattaaaatgttctaaaagaattggaattgatgcatacaaaaaattatatgtagacatttcatattcgttttgttttaaaatatcaccatatgtaatgcaatttttattagaccagataatatctaaaatagaattaacattttgaatattcatagcaatacgttcaatgccatatgttatttcaccaggaataggattgcaattcatacctcccatttgttgaaaatatgtaaattgactaatttccataccattttgccagatttcccaacctaacccccacgctcctaaacttggggattcccaatcatcttcaataaaacgaatatcttcttgtgtaagatctatacctagatatgataaggaatttaaatataattcttgcatatttaaaggagatggttttatgatgacttgtaattgataataatattgcattctattaaagctttttgcatatctaccatcttttggtcttcgagttggttgaatataaactgctttccatggttcaggccctattgctcgtaaaaatgtagcaggatgaaaagttcctgctcctatttctatatctaatggttgcataattaaacaaccaatatcactccaatatttttgtaatttaaaaattatatcttgtaaactaaagtactttttcatacttttaaattactacgtttctatgtaaatatttttattgtataataaaaattattaattataaattgttttccattttttaaaatatacataattttttaattttatttttaataaaaatgttgataactatattttttaaattcaaaaggatatcctttaaataaaaaatttgttttcaattcagagatgatttctcctatttttataatagggatattcaatgttttagaaagttttttaataattctcctttttgaagaaggtgctgtaaaacataactcataatcttctccgcctgatattgcaatttccatagcttcttttttagtaaaaatatttaaatctgaagcaataggaatattttccataaaaatattagcccctacattgctacaatttaaaatatgttgcaaatcccccgaaagtccatctgaaatatcaatagcagaatttgcaataccaatcaatttttttcctaaattaatgcgaggtttaggtttaaaatattttaatcgagaagaaagaaaaattgaagaagatatttttttatattgtttatttgttaaaaaaaaataaatcgctgcttttcctaaacttcctgatacatatatatcatctttaaattttgctcctttacgtaataaatatttttcaggtttaacaaatccttgtatttgtatagttatagaaaatggtccacgacaaatatctcctcctataatctcaagagaaaatttttctgaaatattaaataacccccgagtaaatttttttataaaatttgttttaatttctggtattgttaaagacaaagtaatccatgcaggatctgctcctattgccgccatatcgcttaaatttactgctattgctttataagatattaattctggtggatcatatttttgaaaatgtacaccttctaataaggtatcagtagaaatagctatttttttattatcaggaggatttacaatggcagcatcatccaaaattcctacaataacatcttttctttttattttttgcttgcttttaatataattaattaattcaaattcattcataaaatttttttttgaaaaaattattaaatatattaataataataaaattacatcaatatataaaattaataaatagaaatatacactaaaatagtatactctgtatattttttttaagggaaaatggtttctttgattagatttttaaattgtataatctgagatactttatctttctatattttaaatatttatgtacagaccaaatgatattataaaaaaaataaaagaattaaaaatttcttttattgatttaagatttacagatacaaaaggaaaagaacatcatattactattccaaaaaatattataaatgaaatattctttacagaaggaaaagtatttgatggatcttctattttaggttggaagaatgttagtcaatcagatatgctattaattcctgatttagaaacagtaatagaagatcctttttcttccgaaaaaacattgaatattcgatgtaatatttttgatcccataacaaaattgccttataagaaggatcctagatcaattgcacaatgtgcagaagattatttaaaatctacaaatattgctgatactgtatattttggtcctgaaccagaattttttatatttgatgatattcgatggaacgttgggattaatgaaagctactataaaatttcttctaaagaagcaatttggaatagtggaaaaaaatataaagaaggaaatatgggacatagacctcatataaaaggaggatattttccagttccaccaatagattcctcgcataatattcgttcagttatgtgtaaaatcatgatgaaaatgggtatagaaatagaagcccatcatcatgaagtagcaacagccaatcaaaatgaaattgcaacaaaatttaattctttaaaaaaaaaagcagatgaaatacaagtcataaaatatatagtacaaaatgttgcaaatatgtatgggaaaagtgctacatttatgcctaaacccttaataggggataatggatcgggaatgcattgtcatcaatctttatttaaaaatggaaaaaatattttttctggaaattattattctggattatcaaaaaaagcactttattacattggtggaattatagaacatgcgaaagctattaatgcttttacaaatgcaagtactaatagttacaagcgtcttattcctggatttgaagcaccagttttattaggatattctgctggaaatagatcagcatctattcgtattccatatacacaaaatgcaaagtcccgtcgtattgaaattagatttccagatgcatcaggaaatccatatcttgggttttctgcaatgatgatggcaggtattgatggaattataaataaaatttttcctggagatcctattgaaaaagatttttataatataaaaaataatgaatttcataaaattcctagagttgcttcatctttaaaagaagcacttattgcattaaaaaatgattctgatttcctgaaaataggaaatgtattcaataatgatataattgattcttatattaaattaaaaaccgatgaacttgaatctttagagatgacaactcatcctttagaatttaaaatgtattatagttgttaaatataaaaaggtattacttaatgaaattacaattatctaatagaggatatgttaattcaattgctgaaattatttcaacgcatgcaagaaaattaataaataaaaaaaatgaaattatatatatgaatataggacaacctagtacaggagttcctcaaattgcaataaaaaaattaaatgattatagtcaaaataatatattaggatatactccggttacaggtttgcctatattaaaaaaaaagatttctcaacattataaagataattatggtgtcacaattgacgaatctagaattattattacttttggagcatcttgtgctattattttagcaattttatctttatttgattataatcaaaatattgttattccattgccttgctatccagcatattatcatactataaaaatacatggagttaatccaatattaattgaaacacaacttaaaaataattatcaaattcaaatttcccaattagataaattaaaaaaaattaatggattaattataactagcccgggcaatcctacgggatctataattgatcctatagaattaaagaaattaattacatattgtcgaaaaaataaaattatttttatttcagatgaaatttatcatggtattagttttaacaaaaatcttagacccgaaacagctttgtctttttcaaataatgttatagtagtgaatagtttttctaaatattattctgctccaggatggcgatgtggttggatggtagttcccgaaaatttagtaaaaagtatttctcatattgcaagaaatttatatgtttcgcctaatgcgccttctcaaattattgcatatgaatgtttcaattgcataaaagaattagataaaaatattcatagatatcgaaagaatagagaaattttattagaagaaatgcctaaagcaggatttatagatgcagcttcacctgatggtgcattttattactatgctaaagcaaaaggcataaaaaatagtttaaatttttgtatagaaatgatgaatagcattggtgttgttgcgtctcctggtatagattttgatcctattaatggaaaagattatataagattttcttatgcaggaagtacaagagacatagaaatagctgtaaaaagattaaaaaaatggagaaaaaatatataaaaattattttaccctctctttataaaaagagagggataaaataaaatcagaatcttttatttaaaagatagacttttttcttctccatatcgaacacgtacatagacatacaatggtatgctagtaagcataagtatcataccataaaatataatttcttgtccggaagctagtattgtccaaaaagaatatatagatgctaaaatagcaattattacatgtttcgtagcaccagagttccattttccatttttatataataaaattatttcccccatagatgtaaaaaaatatggtattaaagaagctaaagttgccattaatataattaaattaaattgtttaattaaactagaactcatactcataagtaaaagaattgttataaacaaagaagtaatacataaagcaatggcaggtgtaccttttttatttttttttgccataattttaggaaattgtctattttctgctgctgccattgcaatttgtccttgcaataaagtccatccattaagagcaccaaaacaagaaatagcagcccctatggctataatatctcttccaattggaccaaaaataatgtttgctgcatctgcaaaaggcgatgttgatttagatagttctcctgaagaaatcatacccataattactgttgaacttataatatatataatagctgttaataaagttcctaaaatagtagcaataggtatatttctttttggattaattgccgaatttgctggtatagttgctgattcaagacctataaatgcccataaagtgaatacagcaccattagatactgcataaaaattagaatttcctgtaatattaaaacttttttgtaaaaacacaggatgaaaatattgccaacctaaaacacaaataaataatattggtattaatttacaaatagtcgatattacttgtaatgttcctgcttttcgaacaccaatgatattaacaaaagttaacaaccatactataaaaatagccgataaagctgtattcaattgtgaatttaaaataggaaaaaaaacacgtaaatatccaatcatagcaatagcaatagctgcattgccaacccataaagctatccaataattatatgctgtttgaaatccaataaatggaccaaatgctttatgcgtataaatataaagtcctcctgttttaggaactaaattaccaagatttgcaaaaaccagggccaataaaatagatcctatagaagttagtatccatgaatataatgatatacttcctatagaagctaaactagatggtaaaagaaatattcctgaacctatcatatttcctgtaactaatgttattaacataataagactcattttcttattcatgtttttttaatctccatttaatataatatatattataataataaaaaaaacataaaagagatagagtttatctaatgataatcagataaactctttacttactataattttatacttttactttaaaagttttaaatactctagcatagttattgcatcagaaactttaaaaggatcattaggttcaaatttttcaataaacatcttatagatttttgtattaataactaacattgaatatctccaagatctcattccaaaaccaagatcctttttatccaccaacatattcatggctttagagaaatctccatttccatcaggaagcatcttaactttagatattttttgatttaaagcccatgcattcataacaaacgtatcattaacagacaaacaataaatatcatctactccttgattttttatgtcttctgcatatttttcatattctggtaaatgctttgaagaacaggtaggtgtaaaagcaccaggtaatgaaaataaaactatttttttattttgaaaaatttgattactattgatagtaatccatttattatcttctcgaattttaaaaaatatattaggaatattttttccggtttgatcattcaacatctttttctccatatttaatttagtaaaatatttttattttttctataattttttttagtgttatatctataaaattacatatatttaattatcttaaacatccatgtagatattttagataatataatgttatttataatatgtccaaaaggaaaatcataccattttgctttataattccatttttttaatctcatataagattttcttccaaatttataatctattattatatcttttttaccatgaatcataagaattggtgttctataattagctggagatttatctatatttaaattttcaaacactggtaaatatgtagaaatgccaattataccacctaatttcttagtatgtgttaatcctgtatataaagacattgctccaccttgagaaaacccagaaataaaaatacgatgatatggcatccctaatttatactcttcttcgattagatttcttaacaaatcagaattttttaaaatatccttataactttctaaaattgagtttttttttaatattatattataccaagaacttgttttaagtcctagcatacaacttacagattgcataggtgcttggggaaaaatatacttaatataattagataagttaatattagaaatttttttacaaaattcataattttttcctcctaatccatgtaaccatatgatagttcctaaatgttctcgcaatggtaatgagattattttggatagttctttcattttataataaacaatgttttaataaaattaaatttgctataataatcaaaataaaataaatatttttttctaaattagattattatcaataaaacatttttatttttaaaaatcaaagaaaatttaaaaataaataaataattaatataatttattactaataaaattaaggaatttaaaaatatgaaacattttgttttagatgtaacttctgatttatttaacaatatagttttgaaaagttctattcctgttattgtggatttctgggcagaatggtgtcctccttgccaaattcttgatattctttttaaagaaatttcagttgaatatcataaaaaaataaaattttgtaaagtaaatattcaatatcaagaaataattgcaaaaaaatatgatataaagagtgtacctactttaattttttttaaaaattttaaaaaaaaagcaattcatttaggtaatattgatcgcattcatttaaaaaaatttattgatgataatatataaaaaattttaaaattttttttaaaaaaatatagttatttttattttaatacaataaaatttattttattctttataaaaaaacattgaatgaatattaaaatacatttttgtaatgtatatttttattatatttattatcttataatatatattcttaataataaataatttctaaaataactaatcgatattataaattcaatatataactaggttttaataaaaacatgaatctatcttatttaaagaaaaaatctgtttctgaattgatagaaattgctaattctattggcatagataattctggaagaattcgaaaacaagaattaatattttctattctcaaagcgtgtataaaaaaaggaaaagatatttatggtaatggagtattagaagttttggcggatggatatggatttttaagatcttcagaaagtttttacattgctagtcctgatgatttatatgtttcaccacaacttatacgtcgatttcaattacgaacaggagatactatttcaggacatatactacctccaaaagaaaatggtgaaagatacttttctttaataaaaattattagtataaatttagattttccagatgcaactaaacaaaaaatattatttgaaaatttaactcccttatttcctcaagaaaggctgcgaatggaaataggaaatggatcaaatgaagatattacagcacgtgttattgatttagcttctcctattggaaaagggcaacgtgcattaatcgtagcaccacctaaagttggaaaaacaattattttgcaaaatattgcacaatcaatatcttttcaatatccagaatgttatttaattgttttgttgattggtgagcgtcctgaagaagttactgaaatgattcgttcagtacgtggagaagtagtatcatcaacatttgatgaacctgctattagacaagtacaattgtctgaaatagtaattgagaaggcaaaaagattagtagaacataagcaagatgttgtaattttattagattcaattactcgtttggctcgtgcttataatactgttattcctgcgtctggaaaaatcttatcaggaggtgttgattcaaatgcattacaaagacctaaacgtttttttggagctgctagaaacactgaagaaggtgggagtttaacaattatagcaacagcattaattgaaacaggatctaaaatggatgatgttatttttgaagaatttaaaggcactggaaatatggaaatacatttagatagaaaacttgccgaaaaacgtgtttatcccgcaattcattttaataaatcaggaacacgtcgagaagatttacttacttcatcaacagaattacaaagaatatggattttaagaaaaattatgtcgcctatgaatgaaatttcagcaatggaatttttaacagaacacttacgtgaaagcaaaacaaataacttattttttaaagcaatgaaacgacaatgattatacataaagatttacgatcttttataaaaaatttagcaaaaataaatgaattaaaatatatttctgaagaaatagatccatttttagaaataacagaatttagtcgtcgtattttacaaaaatcaggaccagcattgttttttcaaaatcctaaaggatataaaattcctattttaactaacctttttggcagtttaaaaagaattgctttggcaatgggatttgataattataaagaattaagaaaaataggtgaattattagctgaattaaaacaaattactcctccaaaaaattttagagatggtttaagtaaaataccacttataaaaaaaatatttgatatgaaaccaaaaattattaaatatcctgtatgtcaagaagttattataaataaaaaagaagtagatcttttagagtttccaatacaaacatgctggccaaaagatatatcacctttaattacttggggtttagtaacaacaaaaaatttaaatactaatcaacaaaatattggtatttatagacaacaaatagttaatagaaatcaattagtcatacgttggttaaaacacagaaatggtgcaataaattatcaaatatggaagaaaaaatatcgaggtaaaaaatttccaattgctatttctttgggtacagatcctataatggctttagcagctgtatctcctataccaaataatctatcagaatatgcatttgcaggtttattaagaaataaaaaaatgcaaattgcacattgtttaggaaatgaattagatattcctgcccatgcagaaataattttagaaggatatttagatggaactcttcatccagaaggtcctttcggcgatcatacaggatattataatactgtagaaaaatttcctctttgtactatagaacgtattacacatcgtgtaaatccaatttatcattcaacttatacaggaaggccaccagatgaaccttcaatattaggagtcgctcttaatgaaatttttattccaatattacaaaaacaatttccagaaattatagatttttatttaccgccggaaggttgttcttatcgtcttgctattgttagcataaaaaaactatacccaggtcatgctaaaagaataagtatggggatatggtcttatcttacacaattaatgtatacaaaatttatttttattacaagtgatgatattaatattagaaattggaaagatgtgatttggtcattaacaacacgtgttgatcctatgagagatgttactataattgataacactcccattgattatttagatttttcttctcattcttcagatttaggatcaaaaatggccattgatgcaacaaataaattgccaggagaaacaaaaagatcttgggggaaatctatacatatggatacaaaaattaaagaaaaaattaataatttacttatttctctttctattttatagaattataaaatatatttactgagattatcactttttaatagtatctttagatgcaaattaacatattctttgttaataattatattttttttactttgatcagaagcattaaatgaaatatcttcaagcaaacattccataagtgtatgaagacgtcgagcaccaatattttcaatttcttcgttaactttccaagcaatttccgcaatcctatgtatagcatcatcttgaaatttaatattgacaccttctgttttcaataaagcgctatattgttcaactaaagatgctttaggtttagttaaaatagatttgaagtctcggaccgataaagcctttaattcaactctaataggtaatcttccctgtaattcaggaattaaatctgagggtttagacaaatgaaaggcgccagatgcaataaataatatatgatcagtttttatcataccatattttgtagaaacagtacttccttctaataagggaagaagatctctttgaacaccctctcgtgatatatctcctcctcctgaaaaattttctcttttacaaattttatcaatttcatcaataaatattattccattttgttctaaattttctattgccttagatttaatctcttcaagattaattaattttcttatttcttcttcttgtaaaattttaaatgcagattttacaggtacttttcttgttttctttcttctatttccagaattaatattctcaaaaagattttgtaattgttgggtcatttcctccataccaggaggtgccataatttccatgctaatttgtggattcgataattctatatcaatttcaatatcatctaattcacctttaaataatttttttctaaattctttatatatctctgtttcctttataggattttctgctaacattttttgatctggggatatattagaaaaaccaaaattttttgaattattttctttttttttagataatatgataatatgtaaaattttttcttctgcagaaagaaaagcttttttttgaaccttattttttgcatcctcttttgtcattttcatagaaacttcaattaaatcccgaatgatggattctacatctcttccaacataccctacttctgtaaattttgttgcttctacttttataaaaggagcattagccaattttgataatctgcgagctatttctgtttttccaactcctgttggaccaatcattaaaatattttttggtgttatttcgtttcgtaattcaggagaaagctgcattctacgccatctatttctaagagctattgctacagatttctttgctttttcttgcccaataatatggtaacttaattcactgataatttctctaggagtcatttgatacatatttaagtttttcctataaaatattaaatttcttcaattgttaaattatgatttgtatatatacatatatcagcagcaattcttaagcttttttctacaatttttcttgcctctaattgagtattatctattaatgcccttgcagcagattttgcatatggtgaaccagaaccaattgacataataccaaattgatcttcacccataacatctcctgaaccagaaatcattaaagttatttttttttctgctactaataacatagcttctaatcttcgtaaaatcttatcagaacgccaatctcttgctagttctacagcagcacgttccaaattcccttgatacatttctaattttttttcaaatctatcaaataaagtaaaagcatccgctgttgatcctgcaaatcctgcaagtgtttttttatgatataattttcgaacttttacaatattatccttagcaaccatattgcctatagttgcctggccatctccgcccataacaactttattattgcgacgtactgaaagtacagtagttccatgaataatcttcataagaaacctattttattttatgataataacctacttaattcactacaatggggttaactataaataattcaagtgatatataaaatattaaaaaacaataattgcataattatattaaaattttatatttcttccctagaaatagtagcaatcattaatgctttaattgtgtgtatacgattttctgcttgatcaaaaacttttgaattataactttgaaaaacttcatcagatacttccatttctgaaataccaaaatttttgtataccatttctccaatttttgtttttctatcatgattggcaggcaaacaatgaagaaacaaagtgtcatgtatacctgttttttgcatcatatctttatttacttgataattttttaaaagagatatgcgatcagataaaattttttcttcgcccatagaagcccaaacatctgtgtaaataacattagaatttttaactccttcagaaatattttctgtaaactcaataatagcacctgattttttaacatattcttgaatcgatttaatgctttttttatcaggaaataatgatttaggaccaagtccgacataatgcatacccatttttgccgctccgatcattaatgaattagctacattgtttctgagatcgcctacataagttaattttattttgttcaaagaagtatttttatgttctaatattgttagaaaatcagctaatatttgtgtaggatgataaagatcagttaatccattccatacaggaattccagaatattttgctaataattcagcagttttatgatcaaatcctctgaattctataccatcataatatcttcctaatatcttagctgtatcttctatagattctttttcttctatttgactatttgttaaatatgtaatattagcaccttcatcataaccagcaatttcaaatgcacatcttgttcttgtagattttttttcaaatattaaaacaatattttttctatttaatctaagtgggaaaatattgttttttttttcattttttactttttttgctaaattaagcaaatattcaatttcttgaaaattaaaatcttttaaagttaaaaaactttttcctagtaaattcataaaatatacactatttatattattgtaatataataattaaattaaattgttaatacaaaatttgcaaacttttattttattttttattaaaaaattgatttaaaatattttttaggttttacaaaagttaagatcaataaattttgtatttgaaagaaaccatgtttcaattaataaacaagcagcaatactatctaatctgttattttttttatctaatcttttctttctgttaaaaaattgatattcttttattctaaataacgattctttagttgtaaatctttcatcaattccaataattggaatattataacgaagaaaaattttttgagaaaatttaataattgttttttttagagatatattagcatttttttctttaataggaattccaataattaatatatttggtttataagattgtatatttttatcacattgttgccaaatagggttgccgttattagcaataactatctttaaaggattagcagtgtaagtaattgtttgtcctactgccataccaatataatgcattccaaaatcaaaagatataacaattttattgtgcataaattaacaacaaaaatatttttaatatttttatagaatctttatagtaaaatctcatatatatcacataaccttatattagggttattttaatatattgtattaatataatatattccataattatatttctaattttaaataatttatttaaacttaacaagttaatttttaaaattgataatataaaaaaattgaaaaaaaaattataaatccaatccattggttattattaaatgctttaatggaattttttacacggcttatttgtaaaagattatgttgatataaaaataaaaaaaaacaaaaaaatattggtataatataataccatttaaaagataaataccatccaatacctatccaattaataattgcaattatttgaaataaataaatatatagatgataatttttatcaaataatattgcagttgattttaaacctatttttttatcatgttttatatcagaaaaagcatatattgtatcatatgatatagtccaaaaaatattactacataaaatccaccaagcatatataggaggaaaagaatttaatactgaagaaaatgctaatatgattccccaattataagatatacctaaaaaaaattgtggccaatttgttacacgtttcatataaggatatattattaataatataataccaataaatgaaaatataatggtaattaaattggtaaataaaattaatccaaaagcaatagataataataatattaaatatatccaagcaattaaaatagaaatacttcctcttgttataggacgtttatgtgttctataaatatttttatcaaattttttatccacaatatcattcaaaatacttccagaagaccgcatgataaatatcccaaataaaaaaataaaaaataaagtccatccaggaaatcctttagaagcaatccataaacttcccatagttgtccaaaacatatgcattataggaataggtttgtttaaacgaataagatgaataaaatttctaaatttttctttcaaagaaaatattttaatttgaaaaaagtttaatggtttaatttgaattgcatttgataataaaatttctgtaataattataggtatttttttccaattaaaattagttttttttatccaaattttatttggcaaattaaacaatgatatagtatttgcgtattgcaaaaaatctttatataaaggattagttttatgtaaagaaaaaaattttgaagtatatttttttacagaagcattatatgtaaatagaaaaaaatccatattatttttattatagtttcctattttttttacaaaagtttgataatcatgagatttcatctctattcttacaaagaagaatatttttttatgagaaaaaaatatatcttttatccaaaatttttcaaaatatttttgcttcaaaatttgaattctaaatttgtttccaattatatatttaaaatgttcatataaagaaatatctgcagaaagccattgccaatatctttttgaaaatttactaattttagttatccttataataattttaaaaattatttaaaataatgtaatacaaaaaatatatgtattaaaaataatttttaagaaatttttaaaaaaaaatattattttaaaatttaaattttaaatattttaaattttacttttagtaaaataatattttttatttaagttattttgattttataattttttatatactcattattagttttatgttgtgttttcttttaaagatttttttatatttatattttagattaatctttaaaaaaaaattttctacaataatacttatagtagtataatatatttttttaaaatctaattaaagttaatttttatttcttgatttattttttagttctaatttattttttataaaaatttattccttattattattttaattataacaaccaattttttatcgaattttatcctttataattattttttataaatattttttttaaattaattaaaaaaaaattttattgaaaaacacatattgtattttataataattctttaacagaaattgagataaaatttttattttaaaaatgtcaatattaaaacatcctaaaccattttatattattttttttaccgaggcatgggaacgttttggatattacggtatgcaatctctattagttatttatttatctcataaaatgaaaatgaatgattcccaatcttttaatacatttagtgctttcaccgctatgatatatgcattagttagtgttggaggatatattggagaccatatattaggcacaaaaagaactctaatattaggaggaattattttatccataggatatgcaatattaagtatgaataattcgtctttattatatataagtatgggtattatttgtgtaggaaatagtttatttaaagcaaatccatcaaatttattggcaaaatgctattctaaaaacgatcatagaatagatggagcatttactttatattatatgtcaataaatttaggatctttaataagtatgattttagctcctattatagctgaaaaatatggatggaattatggattcttattatgctctgttggtttgttaattgcaataataaattttcttatattttataagctaatgaggaatgttggatcattagtggatataaatccaatatcatatataaaaataatagcaataatattagcaagtattttaatagcatttttttgttcttatatattaaaacatttatttattgctcattttttactttttttagccaacatagtaatattaataatattttctttagaaattattcgttctaaccatcaagataaaaaaaaattattagtttcttttattttaatgttagaagcagtagttttttttgttttatatcaacaaatgcctacatcattaaatttttttgcaataaataatgtagaaaacaaaatttttggaattgaaataaatccattgatatttcaagcgttaaatccattttggatatttttggttagtccaatactggcatggttatacaatttttatggaagaaaaaatcaagatttttctatacctataaaatttactataggtatgtttttatgttctttgtcttttttatgtttgtatatttgtaaatttttttcttcttctcaaggaattgtgaattcttattggataattattagttatttgtttcaaagcataggagaattattagtaagtggattgggtttggcaatgatagctaaacttgttcctgaacgtttaatgggattttctatgggggcatggtttatgacaacttcaattgcttctatatttggtggttttgttgcttctatgactcatataccaaaattattaataaataaagttattactttaaaaatttatactcatgtattcctagaaataggaatatcaacattattaattactatagttatgctttttttatctccagtattaaatagaatgattaatgaaaaaaataaatagaatattttattataaattaattttatgtaattttattattccatatgcaacttcttcatatggatgatttttttttagtgcattaattatattaattatgttatttttttgacaaattaattcaacacgatattctgatattttataaatattatttttttttcctttataaggatttgaaccttttaatgatttgaattgtcctattcctttggtttgccaacaacaatgactataatttttatattttccagcgcctgcatcaaatacagcgttttttactttatcaagaaaatttttgggaacataaaaaaatatttggtacaaaaagcttactcctttttatattttttattaaaataatataattttaatatttccatttaatactacatccaatactcaaattttgaaaaacttcaggatatttttgatttaaaatactatccatagcttcgataagatatttaccggttaccataattttatttccaggaattgattggtcaaatcttccatggtatactaatttatgtttttcattaaaacaataaaaatctggagtacatgccactttgtacttttttgcaatttcttgtgttttatcaaaacaatatggaaattgaaaatttaataatttagatatttttttcatttcaatcggtgaatcttccggataatcaattggattattactagaaatagcaataaaagaaaaaccctttttcgtatatagattgcccaaaaataccattctagacaaaatatgttttacataaggacaatgattacaaataaatgctaaaacaactggcatagaatttgtataatcaaataaacgaataaatttctttgaaatatttggattagtgttcaataatttaaaattaatcatatccatattaaatgcaagaacacttgatttttttatactcaatataataattccaaaattcaatattttaatttttttatattttttttgcaagtataaaaattatatatattttatttaacaataaagattaatataatctaatattaatttagcatgttttttagctttaacatttctccattcttgtattaatatagaatttttatcaattaaaaatgtacttcgtatgattcctatataatttttacccataatttttttttctcctattacattaaaatatttacacatttctttttttgaatcactaatcaatgcaaaggggatgtttaattttttctcaaatttaaaatgatcttctaaagaatcagacgatattccaaataaaataatattttttgtaagaaatttttcatataaatcagaaaattcttttatttcaatagaacaacctggtgtattatctttaggatagaaaaacaatagaacttttttcccttgataattccataaattagttttaatattttttgttgcagaaaaagaaaaattttttattattttcccaattttaatatttttcataaaattttaaactttttaagttaattaataaatttaatgtaacaattaatttttattttttacaataaatttttgtggaaaaagaaaaataaaatgaataaaattttataataaaatttaaaatgatttataatcaatggtttctaaaaataattatggaattttagtaattaaagtagtggctatgccatctaatactaatatgaatggagatatttttggtggatgggtattatctcatatggacttaggaggtatagtagcagcaaaaaaatatgcttctggaaaatttgtaacagcaggaattcaagaaacagcatttattaaaccggtatctgttggagatattttatctatatatgcaaaacatataaaaacaggaaatacctctattacatttcatttaacagcttttgtaaatagattcggtacaggtccctatgaaaaagtaactgaagctagttttacttatgttcatataggaaaagataaaaaaccaaaaaaaataggaataaattaaaaaaatgaaagcaggtattgtattatcaggatgtggatatttagatggttcagaaatacatgaaacagtcttgttaatgttagcattagaagagaaaaaatttttatatcaaggaatttctctcaaaaaaatgcaatgggatgtaattaatcattataataaaaaaaaagaaaaagaaaataggaatattttaatagaatcttctaggataatgagaggaaatattattgatataaaagatgcaaatattatgtcatatgatgcaatcatttttagtggaggatttggtgttacaaaaaattttactaatttttttatgaaaaaaaactatacagttaacaatgaaatattagatttttctaaaaaagcttttaataaaaatatccctatgggttttctttgtatttccgctatcttaatgccatttatttatccaagaggcataaaacttacgataggtaatgatattgaacttgcaaatcttttggaaaaaaaaggtgctaaacatatagcatcatatccttatgaagctgttgttgataaaaaatatcaagcagttagtacttcagcttatatgacaggaaaaacgttaagtgaaattaaattaggaattaatgaattagttagaaatttatttttcttttatataaaacaaaaaaatttataattttattgttttttaaaaaaattttaaaataaaatattaaataaataaatttataatgattttattgttaaattttatattaaataatgggagttgaattttaattgcataaaataaaaatatcaggaagacatacatctattcctaaagaattaaaaaggacattgtctactcttttaccaaaaaaatctaaagttattatgaataatatatgttcttgtagacataatttttctgttggttcagtaagaatcatctcttatacactttatacattaaaaattaaaggatattatggaagcggcattgctgatttttttattaaattttataatcaatttgattgccaaaaaataattaacaagtttaaattatctcgtaaaaaatatatttattaattctgttttataagttgtattgggtatatcaaaaaataaaattatatatatagattataaaaatatcaaaaacatagttatataaaattctcataatttcttatagataaaatatgaaaaatatatatttttattatctttatttattatattcttctcgagaagataacaactctatattctcaatcaattaataaaaaaagatttattcttataaaacatgaaattttatatgtatttattaaaacatatttatataatctttcattttttaatttcatagaagagtcaaaataacttaaaataataatttatcaagaaaagaaagattgctcttttggacagataaaatatattattttttttgaagtaaaaatatttatataaaatcttattctaataaagagtcattaaaagtcattataaatttattcgataaaaataaaatttataattggtcagtaggtaaaattctatttacctcaccatttttatataaagatttatatagggagaaaagttctttaatatttaatttatttagaataatttttatttttttattatttttataacgtataataaatctatgtccacttatttttcttcctcttaagtttttaggaatagaattatatattatatattttaatgcacgtttagaaagcatcattttttttaaacccatattttgaataaaattaattttgttaattacaataataatgaattaatttaaataaatcagaagctaataaacccctttcaccattttttttagcaattatatcagctatatatgaatgtaattgaactccaatacgtgatgcatgttgatttggtattttttgagctaataatcctcctaaaattccacttaatacatcacccattccgccggaagacatgcctggatttccagaataacatatatatagtttttttttacatgtttgaattaaagttccagcacctttgagtataacaatacaattatattttctttgaatatttttgactgctttaaatctatctatttgtattttaaatgttggttgttttaacaatcttcctgcttctcctggatgaggtgttaaaatccatttttttgacgaatgaaaaaaaatctttttataatctgacaatatatttaatgcatcagcatctattactatagacttttttgaagtattatttaatatatattgaaatatttttcttgcccatattgtttttcctaagccaggaccaagaacaatacttgttgctttttttaataaagatttaagttcataacaatgacttataccatatactattgcttctggcaagctattatgtataaaattagcatgttcttttcttgttgcaataataacaagacctgctccaatacgaagagatgcttcagaagataaacgaacagcacctcccattccataatcacctccaattactaatacgcatccgtaagaacctttatgagaatctttaagtctttttggtagttgttttccaattgcatttttaggaagtatataaacagatggttttatttttttgtatatttttttgttttctaattttaatattatattacctgtataatctaatgcacttcctgtaaaaagtccttttcttaaagcaaaaaaaacaagagtaatatttgcttttacagctatatctagtatagaaccagtattagaattaattcccgatggtgtatttaatgatataattattaatttagatttattaatatttattattgtggattttattattccttgtatttttttaatattgcttgtttctattaaagcatcaataattaaatcaccacaaaactgagtttttttggttaatttaaaaaaataattattagatgattttaaaatattttgtttcattttactaaaaataaaatttttttctggaaattttgtataataaatattgtatttaattgatttattattattataatatgctaaggcataaccatgcattcctttgtttccatcaccacatacaatatttattgatcgcattaacggaaaatttttagataaaaatagtagtgtattaattgatatttttttcaatatagaatcatcattttgataatttaaataattttggattaaattaattttttttctagaataggcagatttcatagttctccttcatatatttatattattcttataaaatatttaactaaaaaataattcatattataaatataatttagttattttttaattttaaataaggattttattttgaaaaatagaaaagaaaaaaatattattttagtagataaaaatgataattttattggtttgctagataaattttctgtgcataaaaaaggtctattacatcgagcgttttccatatttattatggataattttggaaaaattttattacaaaaaagaaattacaataaataccattgtggaggattatggagtaatgcatgttgtggacatccatcttttaatgataaaaatattatacaagcaggaataagacgtcttaatgaagaaataggatgttctttacctttgttttataaaggttcttttatttattatgctaaactaaataatggattaatagaacatgaatttgatcacgttttattagggattttaaataaaaaaaaagtaattttaaatattaatccagaagaagtttctcaaataaaatggatgagtttttacgatattcaaaaaaaatatataaaaaatcctaaaatttttactccatggtttataaaagtatttaattttgttatgaaagaaaaaatctggccataaaatatatagccagattcttatctatgtaatattattgtatatataataattttaaaaaattacatcattcctccaccaggcggcattccacccataccaccagatggcatagaattactactatcttcatctttaacttcagctaccattgcttctgttgtgatcacaagagcagctacagatgtcgcatgttgcaatgcagacctaacaacttttgttggatctagtatacccatgccaatcatatcaccaaattcaccagtagcagcattaaatccataattattttctttattttttactaccttattaatgactacagaagattcttcaccagaattagcagcaatttgtcttaaaggagattctaaagcacgacgtaatattgcaataccatgtttttgatcttcgtttgcaacagaaattttatctaaatttttaattgaacgtactaaagcaactcctccgccaggaacaacgccttctgcaacagcagcccttgttgcatgcaatgcatcttcaacacgtgcttttttttctttcatttccacttcagtagctgcaccaaccttaattactgcaacaccaccagataattttgcaagacgctcttgtaatttttcacgatcataatcagaacttgcttcatcaatttgtttatgaataacatttattctagaagtaatagcgtttgaatcgccatttccatctacaatagtagtattatctttactaacttgcacacgtttagaagaacctaaatgttctagacctacattttctaaatttaatcctacttcttcagatattacagtagcaccagtaagaacggcaatgtcttctaacatagcttttctacgatctccaaacccaggagctttaacggcacatacttttactatgcctcgcatattatttactactaatgtagctaacgcttctccttcgatatcttctgcaataaataaaagaggttttccagatttagcaactgtttctaatatacctatcatatctcgaatattggaaacttttttatcaaacaataaaacatatggagtttcaagatccgccatcatatgttcttgattagttataaaatatggagatagatatcctcgatcaaattgcattccttctacaacatcaagttcattttctaatccagaaccatcttcaactgttataactccttcttttccaactttattcattgcttctgcaataatttcaccaatagattcatcagaattagctgatattgtaccaacttgtgcaatagatttattatctgaacatggtttagacaaagctcttaaagaagaaacaactgttatagttgctttatcaatacctctttttaaatccataggattcattcctgcagctactgattttaatccttctactacaatagattgtgctaaaacagttgctgaagtagttccatcacctgcaagatcagaagtttttgaagcaacctcttttaacatttgagcacccatattttcataacgatctttaagttcaattttttttgcaacagatacaccatcttttgtaacaataggtgccccaaaacttgcgtctaaaacaacatttcttcctttcggtcctaatgtcacttttacagcatttgctaatgtatttataccagttaatattttttgacgcgcttcgtcagaaaagataacttctatagccgacataatatttttccttttaaaaattaagttaataataaaaaaaataaaaaaatttaattattcttgaatacccataatatcttcttctctcatcatgagtaattcttctccatcaattttaatttctgttccagaatattttccaaatattactttatctcctggttttactattaatggattaatttcaccattttcacgaaatcgaccagttccaatagctataacttcgcctatttcaggtttttctttgtttcctggtaaaacaatacctccagaactagtactttcagcttgtgcacgacgaattaaaactcgatcatatagtggacgaatcgccattttatatttctccttattattaaatttatgtatatatttattaattttataaaaaatctatatttataagaatatcattttttaacttatcatataaggtcagtattataaaattcaactaaatatttattttaaaatataaaaaattttattaaaaaataaattttttgtttcaaaaaaaaatttaattataagaaataataaattatacttaaaaatatttttttaaagaaaatatgatgataccttatcctaatattaatccaattattatatctttaggaaaaatatctatccattggtatggagtaatgtatattattagtttttttataatttggatattatctatatttcgtatttctcaaaaaaatgttttttttatagaaaaacaggaaattatcgatattcttttttatgctgctataggaatccttataggaggaagattagggtatatattattttatagctggcaaggttttttaaataatccatttataatatataaaatctggttaggaggaatgtcatttcatggaggattaataggtacaattgtgtcattcggaatatatagctataaaaaaaaatgtagatttatttatttaacggattttttcgctcctatggcacctataggaattataggaggaagattagggaattttattaatggtgaattatggggtaaagtaacaaatttacctataggcatgatatttccaaaagctggaccattgcctcgttatccttcgcaactaatagaaatgtttttagaaggagtgatactttttatatttttatggatatattcaaaaaaaaaacgtcctactatgacaatatctttgttatttttaataggatatggaataatgagatttatagcagaattttttcgacaaccagatgctcaattaggatatattgcttttggatggatgactcaaggacaattattatgtataccaatgatattaataggattttttttatttttttatgttgattttaggaattgaaacatcttgtgatgaaacaggaattgcattatatcatacaaaaataggggtattagaaaattatacatatactcaagattatcatttaaattatggaggagttgttccagaaatagcctctagagatcatataaaaaaaattatacctttgataaaaaagatatttaaaaatactaatttttctttaaaagatctcaatggaattgcttatacagcaggtcctggattaattggttctttaatggttggtgcttctgttgcaaaaggattaggatttattttaaatattcctacattagccattaaccatatggaaggacatttattatctcctctaataacatctaaaaatattaacattattccttgtattgcattacttatatctggtggacatacacaaataatcaatgtatctaaaattggttcttataagattttaggaaatacattagatgatgcggtaggtgaatcttttgataaaattgcaaatttattgggttttaagtatccaggaggaaaggaattagaaaaattagctaaaacaggaaattcaaaaagatttatatttcctatacctatgatgaaaaaaaatgatttaaattttagttatagtggtttaaaaacttttacaataaagacttgggaaaaatcagaaaaaaataatcaaaacaaggcagatattgctgcagcttttcaagattctgttgcaaaatctttattaataaaatctaaaaaggctttacaaaatacaggatataaaaaattattagtttcaggtggtgttagcgctaataaaaaaattcgtaaatatcttacaaatcttgaaaaagaattaaaatgtcaagttatttacccttctttccaatattgtggtgataatgcagctatgatagcttatgctggttctattcgttttaaaaagggggaatgcgattcttctctagagataaatataaaacctagatggtctttagaagatttaaaaaatctagaataatacctacaccctagtatctttgatataattataattttattattttttgagatttcttaagaaaaaaattagcaggaactaaatctctattaatatctcctagtggaatggctacaaaatctcttacaaaacatccaggatgtggtaatattaatttagaagattttttttttatatttccatacaataatatatcaatatctaaaatacgttcaccccattttctatttttagttcttccaaaaaacttttctattctcttaaacaataacaatagtgcatatggatgtaaatttgttttgattaatcctacagcattaataaagtttggttgatccttaggacccatgggggaacttttatataaattagaaattgcaattattttaattttaggatgtattgataaatactcccaggctttaaaaatattttttttagaattgtataaattactgcctaatcctatataactttttatcattttaaatttattaattatttttctacaatatttataaaaattttaaatattatattttttttgtaaaatatttatcttggtataaagaactaattgtataatacaaagcaaaggaaatattaaagcatctaaaaaaactaaaaaaaccgtttcaaatccaaataaaatattattaccattatttaataataatattttaatgaaaaaataaggaaaatataagagtaataaatataacataacaataggcatgattttatgattaaattgaatagttgtttttatagataaattaattgcttgtaaaatactaatttttcggaatagaaaaaaagttttagataaaaataacaaaaaaaataatatccatcctggaattatataaaaagaaaatcctaatattataattatattatttaaaatacttaaaaaaataatacgaggaattaaatttaatatttttataaaagatttttttaaatttattgttttattttttttataaaaactaagaaaaatatatttttgtacaacagaagtaaatataatagaaaatagaaaaattactaaaattagtaatgatattattaaagaatttttaatcaaaagattaaaatgattatctatttttaaaatatttttttgaatataaaggcttacaaattgtttaaataaagaaaaaataaaagacaaagaaaatataaatttaatttgaattttataaatattcaaaacttctataaaaaactttttcataccatctaaaaaatatatttaaatttttatttatctttttttaaagcaatattttttttaatctatcaagacatttttttaatacttttaaattttcagtatacgatattcgaataaatcctgtaacaccaaatgcagatccaggtacacaagaaatataagtcttttttaaaagaaaattagaaaattctatatcatctttaagatttaaatttacaatagcttgttttatatttggaaatacataaaaagttccttgtgacggttgacatttaaatccatttaatttatttaattcaggaacaagaaaatcatgacgttttttaaatatatttcgcattttttttataaaatattgatttcccgtaaaagcagaaacagaagcggcttgtgttatagaagaagggttagatgtattttgtgattgaagttttttcatagctgatacaattttttttggtccagcagcaaaacccaatctccatcctgtcattgcataacattttgatactccattaataatgatggtttgtgattttaaagtattatcaatattcaaaatatttaaatgagtattttctttccaaataatatgttcataaatatcatcactaataatgaatattttctttttttttacaatttctgcaatattttttaatgtatttttagaatatatttttccagttggatttgatgggctatttaatataattgctttcgtttttttagtaatagaagattctaaagaatctatattaaaatcttttagttctgaaaattttaatattattggaattccattatggatagacactatatctatgtatgatggccaatatggggaaggaataataacttcatcgcctggatttaatatcgcacctaatacattataaagagaatgttttgcaccacaagaaactataatttcatcagcgtcaaaagagattttattatcgcgttctaatttttgaataatagcttttttaatttctggagtaccatctatttctgtataatgtgtcatacctttttttatagctaaaattccagccttgcaaatatgttttggagtagaaaatttaggatcgccactatttaaatgaataatatccttaccctcccttttcaataaaagagatttttgcataatatctaaagtaggtgatatttttatggcttctatttttcttgatagtttcatattctataaaataaagtattttttaatatattattttattataaggatataaaggagacaagtttttaagttattaatgatttatataatttaagaaaatcattaaaatttatcttaaaatttttaatttacggtattttttcttttttaagtttatataacatagtattatactataattattttcattttatgaattataaaattaagatctaataatgacctttaatcttaaatcgaaatttttaccaaaaggcgatcaattatatgctattaacagtttattaaaaggaataaaaaaatctcttcaatatcaaattttatctggagttcctggttctggaaaaacttttacaatagctaatataataaaaaaattaggtataccaactgtaattataacacataacaaagtattatcatctcaattatatcgagaaatgaaagggttttttcctagtaattctattcaatattttatttcatattacgattattataaacctgaagcatatttatttaaatcaaatatgtacataaaaaaaaaaacaagaataaatcaaactatagaacaaatgagattatctgcaattaaatctattgtacaaaggaaagacactattatagtttctactgtatctgcaatatatggaataggtgatcctaatatttttttaaatattgcattatgtttaaaatctaaagaaaaaataaatcaaagaaaaattttacaaaaattatcaaagttacggtataaaagaagtgattctctaattttagaaagaggagattatcgtgtcagtggagatgttattgatatatttcctgcagaccattccaaaatgatattacgaatcgaattattaggaaatataatagaaaatatttttttatttgatccaataaaaagaaaaaaaagttcctcattatcggaaatagttatttttcctaaacaccattttagtattccgaaaaatattttagaaaaatctatctttaatataaaaaaagaattaaaaattcagataaataaactaaaattcaataatcaaatattagaatctgaaagattagaagaaagaacaaatttcgatatagaaatgatacaagaatttggttattgtttaggaatagaaaattattctcgatattttacaaataaaaatataaaatcaagaccttctacaatttttgattattttcttgataaaaattttttattagtaattgatgaatctcatattactattcctcaaattaaagcaatgtataaaggggaattatcaagaaaaaaaaaattaattaaatatggatttcgattgccttcttctctagataatcgtcctcttaaattttcagaatttgaaaatttaatgcaaaaaactatctttgtatcttccacacctggtttatatgaaaagaaaaaaaatcaaaatttggtagaacaaatcatacgtcctactggattaattgatccaaaaattgaagttcgatcatctataacacaaaaaataaatatattaaatgaaataaaaaaaagattaaaaaaaaaagaaaaaattcttattacaactttgacaaaaaaaaaatcggaattattaacttcatatttaaaagaaaataatattaaagttaactatatacattcaggtattaaaatatttgatcgcttaaaaattttacaaaatttatatttaggaaatattgatgttttggtaggaataaatcttttaagagaaggattagatattcctacggtatctttagtagcaatttttgatgctgataaaaaaggatttttaagatcttattcttcattaatacaaattataggtcgtgcttccagaaatttatctggaaaagcaattttatatgcaaatacaatgactgattctataaaagaagtaataaatgaaattgatagaagaagaaatcaacaaatttctcataatattaaatatgacataacaccaaaaggtgttaaatttgataaaagattttttgacaattttttttctctttcagaaaaagatatttaatttttttaattcaagaacatataatactataatttataggcataaattataataaaaaaattgaaaatttaatataataaaaaattttgtaagatgataattaatatatgtataatgattattacaactattggtgatatatcaattccagctattaaaggaattttttctctgattaaaagaagtattggttctgtaatttctattaaaatcaaagataatggattatgagcagtggattgaaaccaagaaaacaatgctcgaataataattaaaaaaaataataaattaagaattaaaattaataatctaaatatagattcaataataatatataaagaaattggaactcctaatactaaaaacatgatagttgataagaaaatttgtgtagttaaaattattaaaaatgatgcaatatctaatcctttataaggaggaatgattttttgaaatggaaataaaattggatttgttattttaacaataaattgacaaataggattattataatctgatcttgctatttgtaaaaatattctcattataaatgaaattagtattaaatgtgaaattgtatttattagaaataaaaaaattgttataatggtattcataatattcaaatgcaatgtttgttaaaattttaattcagataatttttttttgatatttttcccaatatatatacttttattttgtgcagaaataatagcttttcttattatatcagtaatagaatcttcattaagcgaattgatagcagcttctgtagtacctcctttagaagaaactttttttcttaaagagtgaaaattttttttgctcaataatgctaattgagaaattcctaccatactatttactattaatttttttgctgtatttttttctaatcccatatctaatgcacaagattctattatttccatgataagatatatgtatcctggactacttccgcttattgcagttattaaatccatatcttcttctttttttatccaaattattttccctattttttgaaatatattttctactattttttgactttttagatcaattttattttctttagtgtataaagaagatataccataatttattgatactggaatattcggcatacatcgaacaatagtttttttttggccaaaatatttatgcaaatcatcacaagttatgcctgcgattatagatataattaatgcttgagtttttttaattattaaactatttttttttataaaatcgaatatactatatggttttatagataaaagaataatatctgctaatttaaagagtttttttggatttttttcagtaattatatttaattcagaagaaaaatattttaatttttcaaaattaggatctactacccaaattttgttagcaggataaccatttgcaataagtccctgtataatagctttagatatgtttcctccaccaataaaaagtaatttatattcatgcatatctgtaatttataaaaaattatgttaaattctttttttattgtaacagaaataatatttaataaaatttaattttttatattttataaaaaaatatttcaggaatatttttatgatttatagtatgacaggattttctaaaatttataaaataatgaattggggcaaattagaaattcaaataaaatcttttaatcatagatatctagaattatcttttaatatacaagattttctgaaggatattgaatatgatcttagaaagatgataagaatgtttattcaaaggggaaaaatagaaattatcatttatattcattttgaaaaaatgaaggaaagtttagaaataaatattcctttagcaaaaaaaatattaaaagcagaaaaaaaattagcagataatcttaaaatttcaacatcattagatgcatgtgatttaattttattgcctaatataattattgcaaaaaaaaatcaaaagaatataaaatatattttaaatattattcctaatttatttaaaaaagcattaaaagaattacaaaattctagattaaacgaaggcaatattttgttaaatatattgtatgataaatccaataaaatttgttctattctcgataaaataaaaaatagaatacctaattttcataaaaaatacagtcaaaatattcttaaaaagatttctgaaatacaaataaacaattcaataaattttgaaaaagaaataataaatttattgcgaaaaatagatataaatgaagaattagaaagaataaaatttcatattaaagaagttttaactattattaataataaagatgaaacatattctgggaaaaaattagattttattatgcaagaattaaatcgagaagctaatacattggcatctaaatctattgattattatattataaaattagcaattgaaataaaaatgctaattgaacaaatgagagaacaaattcaaaatattgaatgattaaagaataaaatttataaaaatttctcgaaagaaaaaatattacatgataatctttgtattatatttttttgaatttatatttataatataattatgattagtactaaccaaatacgaaaaatatttttagatttttttaaaaaaaaagaacataaaattttaccatctcattcatctgtacctaatgatgatcctagtttgctttttgtaaatgcaggaatggtgccttttaaaaatttatttttaaatcctgaaaaatctaaatataattgtatagcatcaatacaacgttgtattagagcaggaggaaaacataatgacttagaaaatgtgggatatactgcaagacatcatacattttttgaaatgttaggcaatttttcttttggttattattttaaaagagaagcgatacaacatgcttggttttttttgactgaaattatttctcttcctatcgaaaaattgtggattacagtttttgaaaaagatattattacaaaaaaaatatggattgatgaaataggaataaatccaaatcgtttatctaaaataggatataaaaataatttttggaaaatggatagcacggggccttctggaccttgtacagaaattttttatgatcacggtcctgatgttgaaggcggtcctccaggatctataaatgaaaatggcgacagatatgtagaaatatggaatctagtatttatcgaatataataaaagagatgatggtatattagaaaaattatcaaaaccttgtgttgatactggaatgggtctagaaagactatcagctatccttcaaagaacttttgataattataagattgatatttttaaatttttaatacaaaaaattggaaaaatttgtaatgaaaataatctaaatgctatagaattacgagttatatcagatcatatacgatctacttgttttttaatattagatggaataattccaggcaacgaaggtcgtaattatatattacgaagaattataagacgttctattctttatggatacaggttaaatataaaaaaaccatttttttataaaattgttgaaccattaattgaaattatgggagatgcttatccatcactctatacttatcaagatacaattacaaatctaatattagaagaagagaaaattttctctaaaacacttaatcaaggtataaaaattataaattataaaattaatatattaaaaaataaaaataaaaaaattattgatggaaatatggcatttcaattatatgatacttatggaattcctatagatatcacgaaagaaatcgctaaaaaaaatcatttttctatagattatattggttttaacaaatgtatgttagaacaaaaaaaaagatcatataaaaaaaatatttattttaataacattgaaaaatgttttatcaattttactaatattagatctgaatttgttggatatgaaaaatcagaaataaaatcatatataaatattattttttctaaaaaaaatcaacaaattaaaaaattacaatgtggagaagaaggaggcattgttcttgctaaaacacctttttatcctgaaggaggtggacaaattggtgatcaaggggaaataatttcattgtgtaattcttgtaaatttctagtaaaaaatacatataaattttacaatattattttccatgtaggaaaggttataagcggcgaatttaatatttctatgaaagtacatgcttgtataaatactttaacgagaaaactttcttcaataaatcattcagcaacacatttattacattctgcaatacaaaaagtattaaattctaataatattaaccaagaaggttcttttattacatctaataaattacgatttgattttaattattcttctaaaatagaaaaaataaatttattagaaatagaaaatatggttaatgaaaacattcgaaataatcatatagttgaaattatgaatatttctttaaaacaggccaaaaaacttggagctatggcaatttttacagaaaaatacaataaagaaaaagtaagagttttaaaaatgggagaattttctatagaactttgtggtggaacgcatgttaacagaactggagaaattggattttttaaaattatacgagagtatagtgtttcatttggtattcgtagaattgaagctattacagagaatgcagcaatatattggagtcaaaaatcagataatatttgtaattctattgctgaattaataggttctgaaaaaaaaaatatattagaatctataaaaaaaataattataaaaaaaaatatattaataaaaaaaatagaatatttagaacataagaacatcaataatatacaaaataatttactaaaaagcatcaaaataatttctaatatctcagttatcgcagaagaattacatgaaactttaagtttccaactattgcgaaaattagtaaatcaaattaaaaagaatatgaaatctggtataattatattagggtcaaaggacaatataagatcatatttaattattggaataacaaaagatttaactaaaatatttaaagcagtcgaattaggaacttttttatcccgccatatagatggcaaaggaggaggaggttctgaaatagcacaatttactggtgtaaaaataaaaaatctttactttgcaattcattcatctatttcttggatttataaaaaaaatcttaaatattctaaaaaaaatatatattaaattaataaatttaaaaaataaatatattttattttttactttgttaaatttaaaaataaaatataattatattaataatattttatactacattatattcaattacttttcgaattatttgatatttattattacaatttaattttgttctaatgttttcaaaataagattctattgtttttctggaaattcctaaaattataccagtttcttcggcagttttaccttctaaaagccattttacacattctttttctcttgggcttagagaaacaagatgtgtagataattgttcattttcggaaattgtttcaaatggagtaataatcgctgatttaaaccatttttcaggccatatataatgaggaaatgatacgctatttttttctattaattgtaaatcatcagaacaaattctaagaaaagaatgatatattttttgtattttataaattgataatgagtatatatctactttatctatttcatatatagaaaaaaaatcagtatatttcatataattagtaattatagtgtatccatgttctattccaaataaatttttatgtttattttctaaatatttttgatgtgatgtaaattcacttctagttaacgcccaaataatatatccattttgatatttttggggtttttgataatgtacccatgtatatgggtatatattttctttataaaaatattgaagattttctttagaatttgttaataaaattaaacgattatttggataacatctataaaagtctatataaggaatttctaaatataaatttatttgttcgcaaaaattttgaaatgaaaaaatatttgaattaatatttaattttttaaaatcaatatttggagtttgagatttcaaaatttgaatatcatttgcaatttttttattttttatattattaaacataattacctctaaaaaattattatatattgatattaaattatattttttttatatcataaagaatgataaattactatttatgaatatttatagtttataatattaatgataattaatattcctttaataaaaaaattgaattgattaatttgcactttatagatgtctttaaattgttttaaaataattgctaaatatttctattattgataacataaattttatatataaaatatatgaaaactattatatagtaatatcgtattttaaataattcaaatatataattaaaataataaaaattatttaaatatactttagaaagtaaaaataaaaagcgcccgtagctcagatggatagagtacctggctacgaactagggggtcggaggttcaaatccttccgggcgcgccataatacttaatattgttttaaatttatatttttatatcagatattttcatttaattattcttttttttattcaaaagagattgaattatcttttatatatttttatttgaataattttaaaatttcattttaaaaaatcaaaattgaatatgtatttttgaattaatttcttcttgaatttaaattataatacaatgtatagtttctataattttaaataaaaagacttatttgtgaaattaaatcctttttatattaacaatcttgtgaaaacagcattatcagaagatattggaacaggagatataacttcaaatctaattgacaaagattgtttctcttttgcttttataatgaatagagaacctatgatagtttctggaataccaattttacaatcaatatttcaacaaatagataaaaaaattcaatgcaaatattttgttactgattcagatagaattaaaaaaaataaaaaattattacttttatatggtcctactagaagccttttaattgcagaaagaactgcactaaattttttacaatttttatctggaatagctactactactgcagaatatataaaaaaaatttcccacacatcatgccagttattagatacaagaaaaactatacctggattacgtttagcacaaaaatatgctgtatattgtggtggcgggaaaaatcatagaataggattatttgatagttttttaataaaagaaaatcatattcacgcatcaaattctattatatctataataaataatgcaagggtttataacccaaaatgtaatttaatagtagaagttgaatctatagaacaattaattcaagtaaaaaaattaaatgtaaatcgtattatattagataatttttctatacaagatataaaagaatctgtatctattattaataataaaattccattagaagtttctggcaatatatcactaaataatattcaaaatattgcagaaaccggtgtaaattttatttcatctggttctattactaaaaatattaaatcaatagatttaacaatgaaacttgtggagataaaaaacatttgataaaaaattatgatatactaatagtgggatatggcacagcaggtttatgtacagcattacaattagctgatgattttaaaattgcaatttttggcaaagagaacttgcctgaggcaacgagcttatatgcacaaggtggtatcgcagctgtacaagatctttcaattgattctataaattcacatataaaagatacgatgttatcgggggcagaattgtgtgataaatctagtgtaaaatttgttgtaaaaaatgctaaatctttagtagagtggttaataaataaaggagtaaaattcactcttaataataatcaaaataatttatggccttatcatctaaataaagagggaggacattctcatagaagaataattcattctggtgatactactggaaaatcaatacaaataacactatctaatttaattacaaaacatccaaatattgatatttatgaaaattgtatagctatagatcttattttaaataaatcaaaatgtataggattatatatatataatatagaaaaaaattgtgttcaaatttttattggttttataactgtattagcaactggcggtgcaagccaagtatatttatataattctaatccggttatttcaagtggagatggtatgggtatggcttatcgtgctggatgtagattagcaaatatggaatttaatcaatttcatcctacttgtttttatcaatctcataaaaccccttttttaattacagaagcaatgcgtggagaaggagctacattgcatcttcccagcggagaaagatttatgttaaaatttgataaaagagctgaacttgctacacgggatattattactagagcaatttatcaagaaatgcaaagactaaatataaaatatgtataccttgatatttctcataaatcaaaaaaatttgttattcaaagatttcctaatatttattataaatgtttacaatttggatatgatataacaaaagatcctattcctgtaataccagcagcacattatacatgtggaggaattatggttaatcaaaattcacaaacggatataatgggattatatgcaataggagaaacatcttatacaggacttcatggtgcaaatagaatggctagtaattcattaatagaatgtttagtgtatgcctggtcaggaagttcttctataagaaaatatttattaaataaagattctttttgtacattaaatgataaatatattgaatataaatataaaaaaaacagccaaaaaatttctattaaaaaaaaatggaataaaatacaaaatttaatgtggaattttgttgggattattcgaaacaatcaatatttagaaaaagcaaaaaaagaactttttttattgaaagaggaaattgatcaattatatgaattatgttctttaaataaagacattatagaaattagaaatttagtattaattgcagatattattactaaatctgcaatattaagaaatgaaagcagaggtttacattattcaagagattatcctaaaaaaggaaataaattatatatttctgttatatctaaaaataatatgcattttgcaagacgtttttatatataaatttatataaatatttattttattaaaactaaataatagtgcatcattctaatgaaataatatttataaattaaaatataatgatcttaaaaaataaaaaattactttctaatgcactaatccaaattgaaaaacaatttggaaaaggtgcaattatagatatgggaaaaaaatattttgaaaaagatattgaaacaatttctacaggttctattggattagatattgcattgggtattggtggctttcctaaaggaagaataattgagatatatggtcctgaatcttcaggaaaaacaactttagcattagaaacaatatctgaatctcaaaaattaggaggtatagcagtttttattgatgccgaacatgcattagattatagatatacaaaaaaactgggagttaatatagaaaaattattgatctcacaaccagataccggtgaagaggcattagaaattacagatatattgatacaatcaaattctattgatattattgtaattgattctgtagcagcattggttccaaaagctgaaatggaaggaaatatgggggattctcatataggtttgcaagcaagattaatgtcgcaagctttacgaaagcttacatcaaatcttagaaagagtaagactttattaatttttattaatcaaattcgaacgaaaataggaacaatttttggcaatccagaagttaccacaggaggaaatgcattaaaattttatgcttcaatacgtttggatattcgacgtatttcctctataaaaaaaggagatcaaattattggaaatgaaattcgtgcaaaggtagtaaaaaataaattagcaccaccattcaagcaagttgaatttgatattatgtatggcgaaggaatttccaactatagtgaaatacttaatttaggtgtaaaggaaggtattattaaaaaatcaggaatttggtatacttatattgaaaataatcttggaaaaggcaaagaaaatgcaaaaaattttttaaaaaacaatccagatattttccaaaagatttatatttcattgcaaaaccaatatacgaaattaaaaaaataaaaatttatattttttaatttaaataatatttagtttaataaaactattttttaaaaataaaaatatttgaaaaaatcctctatttaagatattatccataaattattttaataaatataggatttcagattttttttgaatactaatttgaaaacgtttaatataaaaaaaaaaaacattaaaagaaattggatttttattgatgcttctaaaaaacctttaggtcgtctttctacagaaatttctttctatcttttaggaaaaaataaaccagaatattctcctcatattgactgtggagattatgtagtgataattaatgctgaaaaagtatttgttactggaaataaaaataaaaaaaaaatttattatcgaaatactggttatataggaaatatgaaaaaatttacttttttagatattttgaataaaaatcctaaaaaaataatcgaaatttctgtcaaaggaatgcttcctaaaaattccttaggtcgttcaatttttaaaaaacttaaaatatataatgacaatatacatccgtatggtatatatgaaaaaatccaaaaaaaacaagataaattaaatgaataagcaatattttataggaacaggtaaaagaaaaacttctgttgctcgtatttttttaaaagaaggcaaggggaaaatttacataaacgggatacatgcaaaaaaatatttttcaagaaaaacctctttaataattcttaaaaaacctttagaattatttaatattagtgataaatttgatatcactattagtgtatctggaggtggtactacaggacaagtagatgctataaagcatggtataacacgtgctcttattacttatgattataatttacgagaaaaattacggaaaaatggttttgttacaagagattctcgaattgttgaaagaaaaaaagttggctttcataaatctagaaaaaaaccacaattttctaagcgttaaattattattagaaataataatatgatttcatctgtaaacaataagaaaaccatgacactttatataaaaaaattttgtttatattgtcattgtgttagaattgtcctttctgaaaagggattaaatgcaaatttaatagaaattaataattcaaataattcaaaacttttacaattaaatccttatggggcaataccaactttggtagatagagatctagttctttatgaaactagtgttataatggaatatttagaagaacgttttccccatcctcccttaatgcctgtatatcctgtttcacgaggacgaaatcgtttaatgatgattcgtatagatagagattggtactctctagcaaataaaattcttcatattcattcttctaaagaagaaaaaaaaatagctagagaatgtttaatagattctttattatcaataacttcagtattttctgattcacctttctttttaagtgaggattttactttagtagattgtagcatagcttcattattatggcatttccccttactgggcattcatcgatttaaaaataaaggaaaagaaatttttgattatgcagatcgtatattttctagaacttcttttaaaaatactttaattgaaagtgatcaagaaattatagaaatttttgaagaaaatacaattaaatagaaataggaataaaaaatcattttatgtcattatattcatgtttaatacaatcaacttatcaatggattattaataataatatgactccttatatgttaatatatacaaaaaatagtaaaaatattccattaagatatataaaaaaagaaaaaatacttttaaatatttcgcctgttgctgttaaaaatttagaaatttcaaataattttattaattttgatgcttctttttcaaaaagaatatacaatattttttttccaattaaatcaatattatctttttattcttttgaaaataaagaaggtttatatatatctaataatggggaaaaaatatttatttatgaaaataaaaaaaaagataatactataaaaaagacttcccatttacaactagttgaataaaaaaattcggagttaattttaatatttaatatagaaaaaaatatacatagttctatatatattttctttgtttaaaataattaattagctccgaacaaaaaaaatgatattaaatttttttattatcttcatattcttcttttaagaaagattcttcttaacatatttttgtatagattttgcatctaaactaaatattctagatatccataagattataaaacaaaaaatagaaagaacaaaatattcatgccaagcggtagaaaatagatgtttaccaccgtaacttccaatatatgatataaatgataaccctataaaataaggccatatccaaatagaagatttaaaatcaatttttgttgttttgtttaaaattttataaataaataagattatcaatccaataaaaagtcctatatccatttttttaataatattccaactactccaataagtcaaaaatgttgcaattaaaaatgaaatataactccataaatatacaaaaggtaatttaaatggtcttttttgatttggaattttatctcttaacgttaataaacatacaggacctatcgaataggtaacagcaattaatgaggttaaaaaagcaatcatattactccaaccaggcaatggtgcaaacataaacataccaataaaaaaatttgctgttatagcataaaacatattaccttgaggtgtgaccttttgaaatattttaggaatatatccatttttactcattccatacaacgaacgagatgcacttccacaatacattaaacctgctgccaaaggagcaataatagcaccaatatataaaagaaataaccaaaaatgtaaatttaattgttgtaatattgaagcaataggactattttcattattaaatagtactaaatttttccacccatatactaaattagcaggttttaatgatactaaaaatgccatttctaaaaaaagaaatattaacatagttataaatacagatccaataatagcaaatggtaatgtccttttaggatttttagcttcacccgccatttctgcagcctgcttaaatccattaaatgcaaatacaatacctcctgaagataaagcagaaacaactccatgccaaccaaaaggcataaatattgtattttctggatgaataatatcttgaaatgaaaaatttttagaaaaaattaaagctattataataataggtataaaaattttaaaaatagtgaaaatactattaaatttcataagccaattcaatgaatacatatttattaaactgataaataacataagaaatgcagcaactatataaccatgtgttgttaattgaccactatgaatatttgttaagctaggaaaataaaaactagaatattgtaaaacagcttggacttcagtaggtgctaaagatagataagacaaccatatcatccaagaaaatacataacttactaaagttccatgtgtaaattgaggaattctaatactagatccagtaattggaatcattgcacataattctgcaaaaacaaatgctataataatcattaaaaaaccacctatcagccaagaaataatagctgatggccctgctattttagaagttagataagaactaaatagccatccagatcctattatggcacttatagaagacagtaatagagaaaatggtgaaattacgcgtttcataatatatttaatttccttatataaaaaaacattttgaaaaatgtaaaataaattttttaattaagaattattttatcacgaaaaaaaaaaatactgtagaattatctttgtatcaatattttgttctttttttttaataaaaaataatacaatatatatattaatcaaatataataataaaaatttatatgattttaaattttttttatgttatacaaaataaataaaattttaaaaaatgcaaaagaattaaaaattcttgctaaaagtatagctaaaattataagaaaaaattgcttaatatatttaaaaggtcaattaggttcagggaaaacaacttttgctaaatattttatttctgctttaggatataaaggtcttgtaaaaagtccatcttataatatagttgaatattatgaattagaagaaaaaaatgtttatcattttgatttttatagaattagaaattcaaaagatctttactttattggatggaaagattttctttgtaataaatctattattattgttgaatggcctgaaaaaggtggcaatttaatgccaaatccaaatttagaaataatatttaatattttatatagtaaaaatactataaaaagatcaatagaaataattcaattaaagaaattaaaaaaaaataaaaatattttgtctatagtatagaccaaggtaatttagtacttattttatttttttttgaattgatagctattggtaaaggaactaaattacctatttttgtttttctaataaaaattttttcttcttttttttctaattgaaaattttcttttgctaaaggtaatccataaaatttaggtccattttcacataaaaatttttgaaaaattttttgattttcataaattctcatatctattccaaaattttcaaatgattgaatatacaattgtggtacaattggtgctgtataacatcctgcagaacaaccgcattcagtaaatttaagtatatgtggcgcactatcacttccagcaaaaaaagatgaattatcatttttagtaattgcatctaacaaagcatcttggtcttctttaaattttaaaataggcaaacaatataaatgtatttgaaaatttttaagtaaatctgatacagtatataataaatgctgtggtgttatagtagcagatgtatttatcccagattctaatataaaatttactgcttctttcgtagaaatatgttcagcaataatttttaaattaggatatttttccacaatttttggagcaatagatgtataaaatatagattctgcattatgttttttatcaaaatattgcgtatttaatatattattatcctctccatgtatagataaaataatattattagattccatttctgcaaaaactccatttttcataaaaaataatagatttggatttttttttatatttgtagtagaaaaaggagggtaatatttacatacttttaaaaaacctgatttagcacccatttgaatcatttcaggtgtagttatttgactaagatacaatggaactataatagtttttaaattattatttgcattttttttaattgtttgaatataagattcaatactccaagagttttttgtatttttccctaaaactttagtaataggcggataagtattaggcatagccactattccataacatttagcttgaatatgatccaaaataatatgttttaataattctccttgacgtaaatgtacatgtaaatcgtaccattttggtaaagatattcgtaatgtttttttcattataaatctataaaatttcttaataatgagaaattatctattattttaattttaaaaaaaataaaatcaaattaattaaaaaagattattatcgtaatataattccagtttttgcatcttttatctgactaggctttaaactgctacctaatttcccttttaaaataccaaatacttggtttaatatttctggttgtaatgccaaatattctttagaaggaggatgtccagaaaaattagcactagtagatattattggacctttaaaagataaagatagttttgcaagtatagggtgtgatgtaacacgaactgctaaatttttgttatctcctattataaatttagaaatataggctttaggaggcacaagccaagtataaggtccaggccaagactgataaattttttgaatttgactttttgttaaactattccaattaatataattatcaaattgattaacttctcctgctactataatcatacccttattaattaaacgttttttgattttaataattttagaaactgcattaatattttttggatcacaagataaaccaaatactgattctgttggtgtaataattacttttcctttttttaaggctataacagattttttaatatttaatattctgatgttcatatataaaaaattatatgatatattgaaagcatgaaagtaagatatttgggaatattccaattataaaagttcctaatccaataacaccaattcctattaatgatatttttgatatgcgaaattttttatgataagtaatattaatatttggtatatatattgcttttataaccttaatataataataagcagttatgattgaaatcaataaaattgatatactaaaataataccaatgaattttaattaattcatttataataaaaacttttgaagtaaatccaatcaaaggaggaataccaatcattgaaaataataacaatattaaaatatatgaaataataccatgattagcatttaacccatttaaatccgtaatatattttatatcttcttttgtaaattgacttaaaattgctaaaatactccaaatgcccagactactaaaagtataggaaactatataaaataaagataatatttctccttttttatttcctataatgattcctaaaaacataaatcctaattgtgcaatacttgaatatcctaacataactttaagatttttttgtaaaatagctaataaattccctacaattaaagataataaagatattataaaaaataagtttatccattttatgtgaaaaaatgaaaaaaataataatctagaaattaatccaaaaatagcaattttagaaattgttccaattattgcaagtacaactattggtgaatcacgataaatattaggtatccacatatgaaaaggtactaaaccaaatttaaagaatattcctgttaataaaaatattaatccaaaatttaatatatttaagttaatattattaaaatgaaaaatttgagaaaattgaaaatatcctgatattccatacagtatgcttataccatataataatatgctggaagcaataattcccattataaaatattttattgcagattgaatagaatttatatttttattcatagctatcattccataaaggggaaataccattaattcaattcctaaatataaaataatcatactattagctgataccaatatcattgaccctaataaagaaaataaggtcaataaataaaattcattatgaattatatttttattcttaatataagattttgaatataaaaatataatagatatgcatatatacatatataatttaagaaaattagaaagattatcagaaacatattgtttatggaaaataaatattttccctaaatgaaatgtatgcaaagttaaaataaataatataaatagagttatctgagataaatgaaatataaaattttgatattttttagaactccatagtccagataacataattacgcatatcataaaggataaaaaaaattcaggtgaaattactaataataatttcatatttatatatattttccttatttaattattatgaataatgtaaaagtataaaattaactaaatgtaacgtgctagtataagaaatattaaagatatattgtggaaatattccaaaatatataattaaaattaacattaataataatactattaattctataccgttaatatcttttattaatataaaagcttttattatattattaatttttccaaaaaatactcttttatacatccataatgtataaactggtgataatatcaatacgaaacttgcaaataaagcaatccaaatatttattttaaaagatgaaagaattattaaaaattctccaataaatccggaagtcccaggaaatcctatgttagataagctaaataacataacaaaaaatgataataaaggcattatgttaacaattccttgataatttttaattatatttgatttaaaacgatcttgcatatatccaatacataaaaataatgctcctgatgaaatagaataagaaatcatttgaaaaatcgcaccttgcatacagataattgcattttctaaattagatttttgatttaaaataaagcaactcataaagattcctaaacttgctaaccccatatgtgacatagaagaataagcaatcaattttttcatattattttctgtaattgcaacaagtgcagtatatattgtagatattaaagatagaataattgtaaaaatataaatattttggtttattccaaaaataatatttaaactaaaacgaataaatccatatattccagttttgatcattaataataataatacaacagatattttacttgaagattcttttaatatatcaatataccaagtatgaaatggccatattggtatttttataccaaatccaataagcaatattaaaaataaaaaattattttctttttttgttagcaaaatattttgcaaagctatcattgaaaaactatgatttttttgttctatatataatatataaaataataaaaaaatagatcctaaaaaattaaataaaaaaaatttaatagatgatttatttttttgaatgtttttttgattaattaatccaatatatattggaattaataatgattctaaaaaaaagaaaaatagaaaagcatcttcggcgcaaaaaatgccattaataattccattaataattaaaaatattgctatatcttttcctatacattctttcacagtcctctttaagatcgaaagtataagaattaaatttaaaaatgatgctaaaataataaatagtactgatataccatctattcctaaagaatatttagcattaagaattggtatccaattatattgttgaacaaattgtaaatgataattgttaggatcaaataaatataataatttgaaacaaataaatatttctaatattagaaatattaatgaaatatatgatattattttaatatttttattaattatatatattattaagcctgtaaatattggcaaccaaattaaaaaatttaaaagattttcttgtaacattctactccttaattaaaatgttgtaaaaatcaatatacaaaataacattaatccaaatattatagaaaaagcatagtaacatagaaaaaaattttgtacttttaaaataaataatccaatattattaatcatcgtttttaatccttgtaagattaaaatatggataatccataaatctattttaatacgaaatatttgagaaatattttttattaatgtacaaatataaacttcataaaattgattaaaatagtattttttaattaaaattttataaataaaagaaaaatatttagaaataatataaggagtttttggatatgctatataacatatccaagatataaaaatgccaaaaatagataataaaaaactccaattaaatatattataaaaaatatatttgtttattgatgaacaggaaattttaatatattttaatacattatattctggtttaataaaaatagaatttcctaataaatttcctaacaatataggtttaaaaaaaaataaacctaaaaaaatacttaaaatagataaaataattaaaggaattaaaatagataaaggagttttttttagaaaaagtttttttttccattttttttttccatgaaaaaccacaaaaaacatacgaaatgcatatatagatgtaaaaaatgtacctaaaatagcacaaaaataagcaaaattgtgtccataaattttactattttctatagaatttatgattaattctttagaaaagaagccagaaaatggtggaatagatactaatgataaacatccaattaacatacatatgtaggtcgttggtatatttttatatagatttcccatatattgtatatttttttctgattccataaaatggattattgaaccagctgataaaaataataatgatttaaaaacagcatgatttaataaatgaaacattccaattggaaaagcagatataccttgtgcaatcatcatataacctaattgagatattgttgaataagcaataatatttttaatatttttttgtacaatagctaaaatccccataaaaaggctagtaattgatccgattataagaatgctgcttaaagcaaaagaagaattttcaaaaattggagataatcttgctataataaatattccagctgttaccatagttgcagaatgaattaaagcagatacaggtgtaggaccttccatagatccttctaaccaaatatgtaatggtatttgcgcagattttccaattgctgcaataaaaaataaaatacaaattaaagtaataatattaaaattaatagatccaataatatgaattttatgggttgattgaataaaagaatttaatttatgaaatattaattgatagtctaaagtatgaaaatgcataaatacaatagatatgcctaaaataaaacctatatctgctattctattaattaatatagcctttaaactagcaatatttgccgattcttttcgaaaccaaaaacctattaataaataagaaaataaacctacaccttcccaaccaaaaaagagcaataaaaacccattagacataactaataacatcattgaaaatgtaaatccagaaatataagaaaaaaatcttttatatcctatatctttttgcatatatccaatagaatatatatgcactaaaagagatataaatgttataataactaacattaatactgttaattgatctataagtaatccaattgtaaattggatatttccaatagatatccaattatatattaattcattataaactggatatttattataaataaataaccaaaaaatatgaaatgaaaataccgtggataagaacattaaaaatatagtaaaacgatgagtatttttaatactaataaattttcccaaaactccgcttattatacttcctaaaaaagggaaaattggtatagaaaataattctatagttattaaatagttatttatcatatgatattaaccttaattaaatattctctgaattttttatattgatatttttttttttttgaaataaagaaattacaatagctagtccaattgataattctgctgcagcaatagttaaaataaaaagaacaagtattttacctgataagaaacctattttaaaatgagataatgcaactaaatttgtactaatagaaagaagcattaattctgatgatatgaataataaaataatattttctcgattaagtattaacccagatatactaatagaaaaaaaaattgttgataatataaaacaattgtgcaatgacacttattttaactcctatttttttctgatttcatttttataatacgaatcctattcataggatttgctttaattttttcttgattagttatttttttattatgaatatttttttgcaaggttaatgtaatcgctataatcatagatacaagcaatatcaacccaataatttcaaaagtatataaatatttagtaaataataaatatcccaaagaaaaagtttcatttatatttttagtatttttcatactagaaaaaagtaaataattatcaaaattattttttaaatttaatccataaaaaaatataaaaaatataattattccagaaaaaaatgcaattatatattcttttaatgttcgagaattttttttttctatttcatcattatttaacatcattaccacaaaaagaaataaaaccattacagcacctacgtataataaaattaataccaatgcaagatattccgattctaacaataaccaaataattgatgtacttataaaggttaatattaaacttaatacagatttaacagtattttttgtaataatcatattacaagcagaaagtatactgataaatgaaaataaataaaataaaattgttctcattatatttttttaagatttttattaatttatactttagtcataaatattaattttttttacgatcttttgcaatttgttcttcttgccattctcctatagctaacaatttttctttagttaaaatattttctcctctatgttcaaaatggtagtcatgaagacgtgtttcaacaatagcattaactggacaagattcttcacaaaatccacaatagatacatttgaataaatcaatttcatacttttcagcacgacgtgatccatctgaatattcttttgatgtaatttgtatggcatgtgcaggacaaacagattcacataatttacaagcaatacatctttcttctccattagaatatcttcgtaatgcatgtaatcctcgaaaacgatttgactttggagagttttctttagggaaagcaattgtaattttaggtttaaaaaaatattttccagttatatacattccttgaattaaatcccaaaacatagaatgtttaataaattgaaaaatttttttatacatatttttataatccataaaaatttataaattagaaaaccaaggatgaatatttaatcttactgccaaagaaagcaaaataacccaaaataaacttataggaataaaaaatttccaacctaaacgcataatttgatcatatctatatcttgggaaagatgctcgtatccaaagataaaaaaataaaaaaatgcttatttttaataacatccatatgataccaataatttccgaattttttgtttcaaaatcaaatccattagaaaatggagataaccatccaccaaaaaaaaataagctaattaatgcagaaattaaaatcatatttgcatattctgtgaggaaaaaaatcgcaaatcgaataccactgtattctacatgacaaccccctacaatttctgattctccttctactacatcaaatggagctcgatttgtttctgctattcctgatatccaataaattacaaacaatggaaataatggaataaaataccaatggcaaataccaccagattgcatatgtacaatttttgtaatattccaacttccggatgctatcattaccccggataaacaaatacccattgctaattcataagatataacttgtgcgccagcacgcattgcaccatataatgcatatttagaattgcttgcccatcctgctataatgataccgtatatagataaagaagtcatagaaaataaatataaaattccagcatttatattagaaatcacttctttttcactaaaaggaattactgcccacgcagctaaagacggaataaaagataataaaggagctgataaaaacaaatatttatttgctaatgatggtaatattggttccttgaaaaataattttaaagcatctgctataggttgtaaaattccaaaaaatcccaatctatttggaccaattctgctttgcatatatccaattatttttctttcaataaaacttaaataagcaatgcttattaataaaggaataagaaaaaggataatttttttgacgataaaaaagaaatatattatttccttcattattttaaatccttttttaaaataatttcattaaaattttctcccaatatattatattcttttattgttcttggaattataatatttttatctggcaaagaagaatctatataaatttgtaatttaatataactaccatgttttttttttgcaaaaataaaatcaccatcttttaaatctaaaattttagatgttttccgggaaatatatacttgactttgttttttgtttaattgagtttcttgtaaacttttagcacgtctaactagcatatcactaccatatactatatatttagaaattcttttaatttttatttgagattgtggcaattctttaggctcgtcccagggttcttttttaaattcaacagattgaatattggtattatattcttccaatatttcatcagaagaattataattaaatccagaaatttttaaaagaaaagcaatttttttaataatcttccaaagaggttttgcttgcccatatggttctatagcattagaaaaatattgtttttttcctgtaaaattaatataacttcctgaattttcagcaaaagagcatgttggcaataaaactgtagcatatttttccatatctctgcttttaaactgtgttattgctattacagattttgattctttaagaatcttcattgttttcatttcaaaatctgtatctttttctaactctaaattaattaatataaatgattttatatttttttttgtgagcattttttttgcatctataccttctttgatatttttttttccaccttctaaacgatgaggaatagctccagccatccatgctccagcagtattagatccttcagttaatattcctccccttgcgtttatttctttttttataatatgtattaatttaatagcaatagaatatttaggatgattataaatataagatcctattaaaagtataggatctttttctttagttaattgaatagaaatttgtcttgctttttcagatatttgaattttatttaacatattttgcatattattagataataaaaaatatttttttttaatttgaaataaagatttcaaaacttccgcaatagataatattatatcatctatatttaataattgatgtatatttggtttaaaaaaaaaatttacatctaatggatttgtaacagcaataaaagatccgtttaaataagctcttcgtattctataatgaagaattggatattgatttcttatgtcacttcctattatccaaattgttttagaaaattctatatcataaaaattgcaatttaaaattggcattttttcttcttgattttggcatgaaaaatctttttgttgaattctatgatcaatattatttgatccaaaacttcgcataaatttttgtgttatataaaattcttctacagtactattagaagaaattaatgtaccaaatacatttgttccatattttttttttattaatttaaaagattttataatatgttctaaagcaatattccaagtaacagatttccatctattatcacgtttaatcataggattcaataaacgatctttgtttattattccttcataagaaaaacgatcgcgatcggaaatccatacttcattaatattttcattttctgcaggaataacacgcaaaacattatttttataaatttgaagcaacatattagatccaatacagtcatgaggagatatagaaaatttagattctatctcccaaggtcttgccttatatcgaaatggtttagatgttaatgctccaactggacataaatctattatattgccagacatttcagaatttatacttttccctaaaactgttcgaatttcagaattttccccttttcctaacattcctaactccagcgaacctgttatttctttttcaaaacgaatacatcgagtacaatgaatacaacgagtcaaatccgtttgaattaaaggtccaatatcaatatcttgaataacacgttttttataatggtaattagatatatctttgccatagcccatggctatatcttgtaaatcacattctcctccttgatcacaaatagggcaatctaatggatgattgatgagtaaaaattccattatagatttttgatattctatagcttttttggaatatgtataaattttcattccatctgatactaatgttgcacatgcaggaacaggtttcttgctattttctagatcaataagacacattctacaatttgcagcaatagaaagttttttatgataacaaaaacgaggaatataaattcctacagaatctgctgcttgtataatagaaaaattataaggaattataaatgtttttttatcaattgtaatttttacttctttttttttcatatatttattataaataatatatattaatttttaattaattgttgaaattcattacgaaacttcaaaatataactttgaactggccatgaaaaagcttcgccaaaaacacatattgttttcccttctatatttttagctattttaaataaatagtctatatctgacatattccctttaccttttaatattttctgtattttttttaaaatccaacctgatccttcacgacaaggagtacattgaccgcaggattcataggtataaaattttaaaaatctacataaaatttttactatatttctagtttcatccaatacaataacagctccagatcctaacatagaacccgcttttccaagactatcataatccatatgacaattcatcatctcttctcctgttaatatttttgatgaacttcctcctggtattactgctttaattttatttttttttctcacgccccctgctaaatctaataatttagaaaattttgttcctaaaggaatttcaaaattcccaggacgttcaacatctcctgtaacagaaaaaattttactgcccccattatttggtcttcctatagaggaaaaccattttggtccatattgtataataggtgggatggatgcataagtctctgtattatttacattagtaggttttccatataaaccataaacagcaggaaatggtggttttaatcttggaaatccttttttaccttctaaagaatttaataatgctgtttcttcaccgcaaatataagaaccagctcctaaatgattataaatattaatattaatttttttattttgaatattatctcctaataacatttcttttctagcttctttaatagctgtttccatacgagaaaaaggcaaccaaaattctccacgaatataattataagctatatttgcacccatagtataacaagctattaatattccttctaaaatttgatgggggttatatttcataatatcacgatctttacaagttccaggctcaccttcatcagaattgcatataacatatttttctccaggtatatcgtaagggaaaaaactccattttattcctgtagggaatccagcacctcctcttcctcgtaattctgattcttttataatttcaattatttttttaggcgaaactttttctgtgagaattttaatccatgcactatagccaccaatacttttgtaagttttaatagaccatggttctttaagatattttgttctaaaacacacttgattaattttcataaaaatttttttttgtattttctataatagaatcaattttcttatatgtaagatttccataatattttttatttaacaataaaactggcgcatcaatacaagatcctaaacattctacttctctcaaagagaataaattatctttagttgtttctccaaaattaatattcaatttttttttaagatattttacaataaaatcagaatttttaagttgacaaggcacattagtacaaacagaaattttattttttccacatggaaaaagttcatacattgaataaaagtacgcgatttccataactgctatttcaggcatatttaagtattttgcaactgcaattatagattctttttttaaatatctatattcttcattttcctgaacaatcattaaagcttgtaatactgctgattgtttccttccgtttgggtatttagaaatccaaatattaatttctttttttattttttctgataattggctaataattttagacatatatttcttataatttccttataatatttattagagcttaaattaccgatcaacatcaccaaaaacaatatctaaagttgcaataattgctggtacatctgataacatgtgtccttgaagcattttattaatagcactgagatgtgtaaaactaggtgctcttatttttaaacgatatggtttattagcaccatcagatatcaaagtaataccaaattcacctttaggatgttcagtgcctacgtatattttcccctcaggaacacaatatccttcactaaataatttaaaatgatgaatcattgattccatatctgttttcatatttttagaatcaggaggtactaccttataatttttttcaattataggcccaagatttttttttaaccaaaaagcacattgttgtataatcttattagattgcctcatttcttcaacacgaactaaataacgatcataacaatctcccttttcccctatagggatatcaaattttaatttattatatatttcatatggttgtttttttcttaaatcccattctattccagaagcacgtaacataggaccagtaaaacctaaagaaatagcatgatctgcagaaactttgcctattccaatagttctttgtttccaaattctattgtttgttaataaagattcatattcattaacacatttaggaaaacgttctgtaaaatttataataaaatcaagaagatcgccttgtctatttttatttcttttatttttttttatagaaaaattgttattatatttcggcatttcttccggtaaatcacgataaactccgcccggtctaaaataagtagcatgcattcttgcaccagatacggcttcataacaatccatcaaatcctctctttcacgaaaagcatataaaaatatactcatagctccaagatctaaagcattagacccaagccaaattaggtgatttaaaattcttgttatttctgcaaacattactcgtatatattgagcacggatagggacttttatatttaaaagtttttcgatagccattacataagcatgttcattacacatcatagatacataatccaatctatccatgtatccaatattttgattaaatggttttgtttcggctaatttttcagtgcctctatgcaataacccaatatggggatcagcatgtttgacaaattctccatctaaatctagaattaaacgtaataccccatgtgcagatgggtgttgcggtccaaaattcatagtataatttttatattctatactcataataatcttatttattctatttcaatcctttgcattatattgataataacgattgtcatttcgtataactttaggagaattattaggagtttttatatttacaggttcatatacaattcttcccaataatttatcataacgaatttctacatttccagaaattggaaaatcttttcgaaatggatatcctataaatccataatcagttaaaatacgtcgtaaatctggatgatttttaaatataataccaaacatatcaaatatttctctttcatgccaattagcattttcccatatttctatgacactttcaatataaggatttttttcatctaataaacattcaaaacttaatcgaatgtttttttttgtagataaaagatgataaataattccaaaacgcttgttaaaaacattttttgttttttgtttaaaatttttaaatggatttttttcgcctaaattagtataactatatccatagtgcagataatcaatcccaactatatcaatcagatgagtaaaatcaatattttttaaatatttagatatcaatctaatatcagaaggaaaaatttctatccatatttgtccttgtataatttttcctttaattaaactttttttaccagaaaattcttttattttttgtaataaattaaataattcattcataaaattctatttctacaaatatttatcgatatattatattatcttttttaattttattttttaattgcaaaataccgtaaagtaatgcttctgctgtaggtgggcatccaggaacatatatatctacaggtacaatacgatcacaccctctaactacagaatacgaatagtgataatatccacctccatttgcgcaagaccccatagatataacccatttaggactgggcatttgatcatacacctttcgaagagccggcgccattttattgcatagagttcctgctacaatcattaaatctgattggcgaggagatggtctaaacattactccaaattggtctaaatcataacgagaaccacctgcatgcatcatttcaatagcacaacaagctagtccaaacgttaaaggccaaattgaaccagaacgagcccagcgtattaacttattcatatttgtggttataaatccctttccacctatcattcccattctaaagccccctttctccattcgtatacaaatccaataaaaagaaatagcaaaaatattatcattcctataaaaccagaaaatggtagtttttttaaaactaaagcccatggaaagaaaaaagcaacttctacatcgaaaataataaaaagaattgcaaatagataaaatcgaatattaaattgtattctagccgaactgaatggttcaaacccacattcaaaggcagaagatttttcttttaaatctgaagtatttggatatttgcttttttctacgaagaaaaaaaatttatttcctattaccaatattattcctaatataaaaagaattaaaaaaaatatgaaaatggaaaaataattatgcaacatatgatattacaaaatatacaaaatgaaaaaaaattataatttatatgtatatacttatgcaagtaaaaaagtgttagataaaaaaaattataatattttggtgccgacggacggatttgaaccgtcaagagattttatcccactaccccctcaagatagcgtgtatacctaattccaccacgtcggcatattttctctaaattaaaaattatattttttttgaagtagcaatattttttgaattattaaaatattttatatgtaattcttgatcataatgaattttattattagctaaataacttaaaaataaacttgttaacaaaaatattaaaaaacaaaaacctgtaattttttttaaaaaaaattcaggtcctttgcttccaaaaaaatctttagaaatggaattatcaaaagatataccaatatttgtattaactcctttttgaaagagaactaatccaacaacaataatacaaatcaaaatatgaaaaaataaaacaatatgtaacataataattaaattatcgttgataatatacaaagtatatattataaaaaaattaataaaaaatgttaagaaatatttttttatgattaaaatatttcaaatattgattattttttaatttttaatattttttacattttttttggagaagaaattcctaataaatataaagatttttttaaaattatttttattgaaaataataaacataatctagcattacgcatgaaaatatcttctactaaaattttttgagagttataataactatgaacagctttggcaatatcttttagatataaaataaataaatgtggttgtaatgtatgtgctgatttttctaaaacataaggatatttatttaataaatttattaaacaattttcatatgagcctttcaataaatgcaatgactttaatccattaatggaattaaatttcaattttttatttttttgcattttaaatacactgcaaattctagcataagcgtattgaatataatataaagaattttcattattttgagatttaataaaattaatatcaaaatcaatatgttgatcaactttatgagttaaataaaaaaatcttgcaatatcatttcctattttttttctaaattgacgaaaggtgataaaaaaaccacttcgtgttgacatttgagtcaatttatcattttttacaattcttacaaattgtacaataggaatttttaaattttgattatttaaaccgaatgcttgcattagcgcctgaattctaagcatatatccatgatgatctgcgcctaaaattaaaattaatcgattaaaacctcgagaaattttattaagaatataagcagcatctgaagcaaaataagtagtttgaccattttctctaattaatactctatctttatcatctccaaatttttttgaatgaaaccatgtagctccttcttttttatatatatatttttttttctttaataattctattgctttttgaatttcattttttttaataagatttttttctgaaaaccataaattataagtaacagaaaattcagaaagatcatttttaatgtcttttaaaatccattttaatgaatattcatatatatatttatatatatcaaattttaataaatattttatattaaaaataagtttatcaatatataattcttgattatctatcatgtcttgtttatttaaattattaaaaatttctttttgcgaaaatattggtatattttttattttttcatttattttttttgcaatttcttttatataaaatccttgataaatattttttggaaaatcaaattttattccatgtaattctatatatcttaaccatacacttatagttaaaatatctatttgtcgaccagaatcgttaatgtaatattctgtataaacagatttgccatattcgcataatatatttgctaatgctgatccatatgcagcacttcttccatgaccgacatgcaaaggaccagtgggatttgctgaaacaaattctatatgccatttttctttgatatttttcttatgtctccatgtttttttttctactaaattttttattatcttaaaatgattgtttttatgaatataaaaattaataaaaccaggttttattactttaataaaatttattaaattatttttatctatattattacaaataatatgtgctaaattattacttgaaatacctatttttttacttaatcttaatgcaatatttgttgaaaaatctccatattcctttttaagaggaatattaataaatatttcatcaaaatatgattcatatataagaaattttttggacttttttaatgcaattaatgaattttttataagtataaaaatggtatttcttatttttaacataaaaattattttttaatataatatttttctaattataattagaatatatatttttttctatgtataaaaattagatatataaaaatattctaaaaatcctttgtaattaatttgcttatttaagatttccttaatatagtgtaaattctagtttgataaatttattgaatttttaaaactattaattattttgaaataaaaaatttcagctacaaagtatatcaatatattgaggaggtaaaaaaatggctgacggcacaattaaatggtttaatagaacaaaagggtatggatttatccagccaaaagaaggaggaaatgatatatttttacatattagcagtcttgaacgttctggaattaaaaaaattaatgatggacagaaagtaacatatgaaatatcagaaaaaaatggaaaaaaatctgcaattaatttaactttaattgattaaatttttatctgaaatttattcaatcctaatttttcctagtcttaaattattaattatttttatgaataggaaaaattcaggattattaatataattataatctttaattaaaatttattctcactttatttgttcttctgcataataagaagatcgaactttaggtccgcttgaaatatatttaaatcctattttttttgctatatatttaaaatatttaaatttattaggagaaatatatctgtcaacttttgtatgaaaattgcttggttgtaaatattgcccaagtgtaatgatatctacattgtgtttccataaatctaataataccttttcgatttcttgatctgtctctcctattcccaacataattccagattttgttaaaatagtaggattttgttttttatattctttcaataaatttaaagaccaaaaataatctgatccgggacgaatttttggataaagagaaaatactgtttcaagattatgattaaaaatatcaggcggatttttatgtaaaatatttaaagctatattaatacgattttttcctctaaaatctggtgttaaaatttcaatttttattgttttatttaattttcttattgatttaatacattctgaaaaatgataagcaccaccatcacgtaaatcatctctatcaacagaagtaataaccacatgttttaaattcataatttgaacagctttagataaattttttggttcttcaggatctaatggaaaaggttttccatgggcaacatcgcaaaaagtacatcttcttgtacatctatcacccataatcataaatgtagcaatacctttttcaaaacagtctgataaattgggacaagatgcctcttcgcacacagaatataaattattttgacgcaatatatttttaatatatgaaatttttaaactttttgatagatttggaagttttgtatacaaccactttggaatacgttttctatgagaattctgaataggttgaattttaataggtattctagataatttatcaaaatttctgttttttttgtttggattataaaattgattcattgcagtataagttataatggcaattattgttataaagttgtgtaattattttttgtaaaaaaatttttcctaaatttattaacggaatatcataatactcagaaacttgagttacttgtaagtttttgaatccacaaggattaatgttttgaaatggatataaattcatttttgtatttatactaattccatgataactttttccatttttaattcttaaacctaaaaaagcaatttttttctctttaatataaatacctggttgattaatttttctttctccatatatatttatagattttaacgtttttattatactttcttctaaaaagaagataaaattttttattcctaattttaaacgttttatatctattaaacaatagataattaattgaccaggtccatgataggtaatttctcctccacgatctgtaaatattataggaatagtagaaggttttaatatattatttgtatttcttcttctgcctaacgtatatacaggaaaatgttctgttatccaaatagaatcttttgtgaatttatttcttatttttgtaaataatttcattttttgatagattttttgatatggcgtgcatcctttatagtaacaaacatcaattttcataatatattttccattatataataatctttatatcagaattttctttaagtttttgataaacttttataagttcatcttcattatttgctgtaaataatacagttactgaaatataattatttttttgaatattttgtgtattaatctgaaggttattttttttatataaattattttttaatatttgtaaaataaatttttctacttttcgattagaaatgccaataattttaattggaaatatacaaggaaatgaaaatttagattttataacatttatatcatgcattaaacaatttaaatcaataaaaaatattttattatatgcaataataaaatatgaatctataactattgtaaataaagatattaaaaaattaattataattattttttctttttaaaaaaagaatttgttatatctaatccttttatattggataaattataatattctcgtgcttttttaagcataatgtgtattgttatatattctatatggattagaatccaatctgtattttttgtaaatccttcaatgcaaagaccttgataattaaaatatttaattttatattttatattctctccaatagcataaatatgttttgaagaagtcccttcactaataataatataatctgtcataaaaaaattttttatatttaaaatttgtatatgatctgctttgaaagcatctaatattttaattaaaaattgcaataattttttttgtttcatttttttaaatctctaaaatactttaataggtaatttttttattttttctcttaaaatttgcaattttgatataaattcaatatgaatttttaatctttttttttgatataaaaagattttttcttcactattagatttgatagaattaattttaaattcatttttttcaataaaataaaaaagtttttctttatctttttcaatttttttaaataatatacagttatatattttttctttattaattattttttttaactcataaattttttgaataaggttattatgtaaaagatttttatccattttatactataaatttttctttataaagatatattctatattaaattaatttttttataaaaaatctaatattaaatagtttttttaaataaattatcaacgaattttttttctttaaattcttgaaaatcattaatattttcaccaaaactaataaagcgaattggaatttttaattcttttgtaatggaaaaaataatacctccttttgcagttccatctaattttgttaaagataaactatctattttaataaaatttttaaattcttcaacttgtcgaaaagaattttgtcctatgcctgcatccaggattaacatattttcatttatcaattttttagaattaaatttagaaattactttggttattttttgtgtttcatgcattaaattttttctgttatgcaatctacctgctgtatccgcaatgataacatctatatttttagcataactaaattgaattgcatcaaaaattacagaagcactgtcagatccgatagactgtgcaataacaggaattttatggtatttcccccaaaattgaatttgttctatagaagctgctctaaaagtatctcctgcagctaatgcaacttttaaattaaggtctttgtaatatttagcaattttagcaattattgttgttttccctactccattaacccctaatattaaaatacaatataacatattatgtgaaggaacataaaattttgataattgacaatgtgtttctgaaagaatcttcagtaattcctctttaagaatttccttaattatttttttattttttatatttttaatttttatttttgatcgtaatatatttaaaacaaaatttgttgttgtaaatccaacatctgcttttaacaatatttcttctaaagattctaagatattttgaatatttgatatattactattaaataatttttcaaaagactcagaaagaaatttggtgcctttaaaatttagtattttttgaaaaaaatattttttcatttttaatatttcttatgtaggataatatataatatatttttgaaattatataaatattatgtaaaaagttaaaattatatatttaataattgttggctccaatataacttatttctcaatgattgataataattataatttttaggatgtaacaatcttaaagtttcatgttgtttattaatatgtattatatttcctgtttttatttcacaattattttgtccatcaaaactaattttaggattagattttttataatatccaattattaatgttattttactagatgcattaattaataaaggacgattagataaagtatgaggaaattttggaactaatactaatgcatccattgtaggttcaataattggacctcctgcagataatgcatatgcagtagatcctgtaggtgtagcaataataataccatcagatctttgggtatatacgaatttattattaattttaacttcaaattcaattaaatgacttgattctcctgaatataaaacaatatcatttaatgcatttccaaaaaagattgcttttttattattttttttaataatgccttgaattaaaaatcttttacattctatgtatttcccttttaatatttcttttagttcatgatgaacatcagaaggattaatatctgttaaaaaccccaattttccttgattaattcctattacaggcacgttatacaaagaagaaattcttgcaacagataacaaattaccatcacctccaacagatataatcaaatcacaattttttgtaagttttttaatagaaataccattttttttttttaataaaaatgctgttttattttctaaaataatagtgataccccaatttgttaataattggtaaatatagttaagagtttttatgacaagaatacttttataagatcctactaaaccaatagtttgaaatttccacattttttaatattttattttcctattattttcaatatatatttaatggatttttttgcagaacctttctgatataaaatttgatatatttcatgtattataggcatatatattctattcttaatagaaaggttataggtaattttaactacataaaaaccttctactaatcctcctatatttttgaatgcattttttatagaatatccttttcctaataaaattccaaatcgtctatttctagattgattgtctaaacaagttaaaattaagtcgccaagaccactgatgccatatattgtatcttgttttacgcctaaggcgcatcctaatttcgatatttcagcaagtccataggttataatactagatttagcattcataccatatccaccaattccatcaattattcctataataatagcaagaatatttttcattgcactactaaattgtatccctataaaatctttagaaatatttactttaaaattttttgattgaaataaatttttaatttgtaaagaaaaatgttttgtatctcctgcagctgtaacaatagtaggcaaaccttttgctacttctgtagcaaaacttggacctgctaatatagctttaaaaatcttttttcctaaaattttattgacaatgttactaaaaaaatatccatttttaaaaaatccttttgttacccaaattaatttttggtgtttcttccaatttttagaaaaaaattttaaagataaatgaaaagcaaaacttggaactgcaagaataatatattctgcaaaataaattgtaggtttatttaaaataaatatattatttgggaattttattcctggtaaatattctttattttccctatcaaattgcattgcttttctatgttcttttcttttactccataaaaatactgtatttttatttctacttaaaactatagctagggctgtcccccaagaaccagatcctataatgacaatattagacattattttttggttttataattttttttatatagcaaagtttttttctcctttttggtataacaaatcaaaatttataggatgtaaaataagttgagggaatcctccttttgcaactaaatcagaaatgctttcccttaaataaaaatataataaattaggacaaaatgaattgactatataattttttttatcttctatacaatttatttcaaatattcccgcttgttttatatcaattttaaacgcaataaattctgaattttgaacattacattgaaattgtaaatttacttcataaaattttttttttaaatgtttattattgtgattaattttaaggttaagtttaggtttccattcttttgtaaaaatttcttttcctaaaggaacttcaaagcttaaatctttaataaaaattttatgaatataaaaattataacttttattgttttcaatcttttgattcataaaatgaataccattaaatattaaaaatataatttaatttattttgtttattaagtttattaagttcatcaaaaccccctatatatttatttccaataaatatctgaggtatactggtttttccagagcgtttgatactctcttcttttatcttattacttttatctatattatatagtatatatttgatatttttttttttaaaaatatccaatgcttttttacagtatggacaccaatcagcataataaatttcaactttaagcattattttccctttttaattgttatattatttattaatggataattttcttctttccattttttaattccaccatctataataaaaatttttttatatcctaatttatttagaataatagcgaattcatttgaaagttttccaaagtcacatactagtaatatatccttttttttattatttttcaaaatatctattttagaataatctttattcaaattttgaatatattctaaatttattgcaccagatatatgttctttattgaatttttctttctttctaatatcaattaaaattgaagaatttttattcataagaataatagaatctataattgataaatagaatttagcatttttgatatattttatttgaaatataatcagaaaaaacattaataagaacactattaaaaaaagataaatattatttcttacaaagatagaaaaattttctatatccataattctattaaaatagaaatattatataaaatttaaaataaattgtctaaatctatttttttattttaatagaaaaagaatgaatatatttaggtattagatctttaattgttttgtatattaatctatgattagaaatttttggcattccaacaaatattttacttttaataatgattttaaaatattttttttcaaaattaaattctgcatgtttaatatgaatatcagtacaatcaataatttttaaataaataggatttaatgaagataaacgttttcgaacctcctcaactaggttttttttattagatatactatttaacatttttttaatttaaaggatggatatatcctaatatatacattaaaaattattatttacattctacttaaagatttaataaaaataaatatttttttatttcaaatattttgatattactataatttcttattatcattttttatacttaataaagtgaatttattataaatattttttattatttaatatctaattttttagataaaattatatattatataaaatatattaaagataacattttgaaaaaaaaagaacgtttacaaaaaatattggctaatcaaggtttagattcaagaagaaaaatagaaaaattaatttcttcaaaaaaaattaaaattaatggaaaaatagctaaattaggagaaaaaataacaaaaaaaaaagataaaatttttgttaatggaaaacaattttttatcaaagataataaaaatctaacaaaatttattatttttcataaatcagaaggacaaatatgcagtacaaatgattttaaaaaaaaaaaatctgtatttcattttttacctaaaatcccttttggaaaatggattatgataggaagattagatattaatacttctggattattattattcactaataatggtgatatagctcataaattaatgcatcccttttataaaattgaaagagaatatttagtacgtgtaatgggcaaaattgatgatatttttttcaaacactttattaagggtgtacaattaaaagatggggttgcaaaattttccaaaattattgatatgaataaagggaaaaactgtaatcattggtataaaataataacaataactgggaaaaatcgacaaattaggcgtatgttaaaatttaaaaatttactagtaaatcgtttgataagaatccgatatggttgtattaaattgcctaaaaaactatctaaaggaacatggaaatttttagaatctaaaaaaatacaagatatttataaaatgataaaataaattataatctaaaattttttttaaaaaatatgaaaaaattaatattaaatgatatttattggatgaaattagcaattaaaattgcaaaatatggtatgtttacaacaaaaccaaatcctgcggttggatgtgtaatagtaaaaaataatacattgttaggaaaaggttggcatactcaatatggcaaagaccatgcagaaattatggctattaattctgtcaaaaataaagatcaattgcggggtgcaacagcatatataactttagaaccatgtaatcattttgggaaaactgctccttgttctgaagctttattaaattttggtatttcaagagtcgtaataggagcaaaagatcctcatgagacaaaaaatgaaagtggaatttctaaattaataaaatctggtattgaagtaattataggcgtttgtaagcctgaatcagaaaatattaatattggatacaattatagctataattatcataaaccttatgtaagatgtaaattagcaatgagtttagatggtaaaacatcaatgatttctggtaaaagtaaatggattagtaatatatcttctcgtaaagatgtacaatatttgcgagcaagaagcggagctataattactggtattaatactattatttttgataatcctactctaggaatacgcgaagaaaagctattgaaaaaatatgatagaaaaattttgcaaccaatttatgttattttagatagaaaaggaagattaccccataatgctaaaattattaaatataataaaaaatataacactattctctggcatgttgtagaaaaagaaactataaatacaaaaaaattaggcattcaaactatacaatataaaaaggaagacaatctatcatggatattaaatcaattatatcaaaataatatacatgatgttttaattgaatcaggaccgactctttctggtcaggctatttcacaaggattaataaatgaattatggatatatattgccccaaagttaatgggaaattggactaatccattattaattttgccagaaataaaaaatatggatgatattatccatttaaaacttatacatgctaaaaaaataaaagaagatttaagattaatatataaaataaaaaaaaaataaattaaggaatattaataatatatatgtttactggtattatttcctatattggaaatatttctcaaaaaaaaaaattaaaaaatcaattaattattagtgttaaaaattgggatttttatccctatataaaaataggcaacagcatgtctataaatggggtttgtttaacagttatagaaaaaaaaaataataatcttacatttgatttatcacaagaaaccatatcatctactacattatggaatttagatattaatgctctagtaaatattgaaagatctgtaggaattaataatccttttgaaggacattatgttaccggacatatagattcaatagcatctataattgatattacaaaaaaaaaatattcattttctgtttctatatgtgtaaataaaaacatagataaatatatagttaaaaaatgttctgttgctgtagacggagttagtttaactgtaaatcaaattaaaaatagaatattcgaaatatctattataccttatacttggcatcacactatattctattcatataaaattggaaatacagttaatattgaaattgatataatagcacggtatattgaaaaattaatacaattttagtaaatataatatggtcgggatagagggatttgaacccccgacattttgctcccaaagcaaacgcgctaccaaactgcgctatatcccgatacttaaatgttatctaatagagaaaaatgtgtcaagaataacaatattttgagattttatgtttaattattcttaataaaatgttttaaatattataaaatttttttataaatccaaattatagatattttaatatgtccaataaacatcaatatgaatttgcaattattattggtcgattccaacctttacataaaggtcatgtatatttaataaaatctgcacttcttcatgcaaaaaaaatattaatattattaggttcttcttatcgagcccgaagtgttcgtaatccatttttatttacagaacgtaaaaatataataatacaagaaataaataaaaatatttttaaatataaaaataaaattattatagattttattgaagatataatgtattccaataaaatttggattaatatggttattaataaagttaaaaaatatgttaagattgataaaaatataatattagttggatataaaaaagataaaacaagtaagtatttatctttttttaaaagatggtatttttgttctattaaaaattatcaatccattaatgctagcggcattagaaagtgctattttatttataaaatgattcaagaaaaatatttaccagaatctagcatagattttcttaaaaaatttttttttactaataattataaaaaattgagaaaagaagcattatttatacaaaattataaaaataaatggattttttctccttaccctataatattttttacaattgacactctattaactataaacaataatttacttttaattaaaagaaagacttatcctgggaaaaatttatgggcattacctggtggttttttaaaagaaaatgaacctattcatataggattattacgtgaactaaaagaagaaacttctattaatttagataataaaactttattaaaaaatattcaaaaaaaacatatatttgatcatcctaatagatcacaattaggaagaattatttcatttgccttttggattaatttaaaaaataaaaatcttccatatattcatgaaaattctgatgcaaaaaaagttttatggattccattaaaaaaaatatatttatttaaaaataaaatgcatgatgatcattattatataattcaaaaatttaatatatttaagttcttaaattagttcaatgaaattaatattaggaattgatccaggattaaatattacaggttttggaattataaattatcaaaatctacaatttcaatatattgctagtggttatattaaaacttcttataaaaacacagaatctgaaaaattatttattatctatactaatatttatcatattatagaaaaataccatcctaaacagtgtgcgattgaagaaatatttgtatctaaaaagaatttcaattcttctttaaaattaggaaaaacaagtggggttatacaagcagcaatatctgcacataaattatctatttttacttattctcccaaaaaaataaaaaaattagtaacaggatatggttccgcaagtaaaaaacaaataaaaaaaatggtatctaagatattagatatttacaaagtagaaaaacaagatacatcagatgctttagcaattgctatatgccatgcattatctcaaagtaattataaataaattttaattttttatttaaataaaaattatataatataatttgtattatgaaatccttaaaaaataaaaatattttttaaattaatatattaatatgattgcaattttagatggtataattttaaaaaaaaaacctccttatattattttggatgttcatggcataggttatgaaatagaaacactcatgtgttattttgaatattttccaaaaatacaaaatagaatatctatatatatatatcatgtaattaaaaaagatattccaaaattatttgggtttactaatttagatgataaatatctatttaaagaattgttaaaaattaatggtgttggttataaaaatgctttatcgatattatctaatatgaagaatagcaaaaattttatacaatctcttataaataatgatataaatagttttattaaaattcctggtgttggtaagaaaatagcaaaacgtatttttatagaaacaaaaaataatttaaaaaattggaataaatataaagaaaataaaaaaaatattatttcaaagaatttaattgattccaacatttttttaaaaaaaaaagacgcaatttcagcgttaatatctttaggatataaggaaacattagtaaaaaaaattattaaaaaattagaaaaaaaaatttataatttaacaactagcgaagttataaaaatctttttaaaaaatatttaaaataattacaacgatatttaaaataaatattaacgataattattatttataattcattttatcataaatttttagaaaattgtatcatacgatttaatgaaattaaggcttttttttgtatagaattttctatatgaatagaattatatccatattccaaagtttcagctaaattttttaaattattcatacccatccatggacaatgagcgcaacttttgcatgttgcaccatgacctccagtaggagcttcaataaaaactttttttggagataatgattgcattttataaaaaatgcccttgtctgttgctacaataaaaacattgtttgaaagagattgagtagcttttaataaaactgaagtagatcctacaacgtctgcaatagcgattacatcttctggagattcaggatgcactaaaattgcagaattaggatattgatattttaattttttaatgccttgagatttaaattcttcatgaacaatacaagaaccattccataaaacaatatctgcatttgtttgtttttgtatccatcttcctaaaaatttatctggggcccataatattttttttttttttcgatctaaatatcgaataatatctagtgcacaacttgaagtaacaacccaatctgaatgagctttaatcatagcagaagtattagcataaactacagcaatacgatcaggatgttgattacgaaattttataaatttttccaaaggacatcctatatccaaagaacatgttgcttttaaagttggcataataacattttttttaggattcaatattttagcagtttcacccataaaatgtacaccagctatcaccaatgtttttgcaggatgggaaataccaaattttgccatttctaatgaatcagatactattcctccagtttcctctgctattttttgaatttctgaatcaacataataatgtgaaataagaacagcatttttctttttcaaaagatctttaattttagcacgatattcttttaataatgaaatattcattttcatgttttttttaatatcaatttttgatttaaataaattcattacgagtatttattcataataaaatagtaaaaatatgatagcatatacttaagtattgtatgcataaaaattttaggattttaatttatgaaaaattgtaaaaaattaagacaaaaatctttaaattatcacgaaaaacctataccaggaaaattaggaactaagatattaaaacctatagaaacaaaatataatttatcattggcatatactcctggtgtagcagaaccagttcgaaaaattgcagaaaattctatgaatgcatatcgatatacaaacaagggtaatttagttgctgtaattagtaatggatcagcgattttaggattaggaaatttaggtgctatagcaagcaaacctgttatggaaggcaaaggtgttttatttaagcttttagctgatattgatgtatatgatattgaaattgattctaaatctattgcttcttttattcaaacagtttacgaaatttcacctacatttggtggaattaatttagaagatataaaagcaccagattgctttcaaattgaatatgaattaaaaaaaattttagatattcctgtttttcatgatgatcaacatggaactgcaatcgttattgctgctgcattattaaatgcgcttgaattaattgataaatttttaaataaaataaaaattgtttgtttaggtgcgggtgcggctggacttgctaccatgaatttattagtaaaaatgggcgtagataaaaatcaaattactgtattggatagtaaaggtgtaatacattcttctagaagaagattaaatatatataaatatgcttttgcaaaacatactaatttgcgaactcttgatgatgcaattaaaaaagcagatgtatttataggagtttctgggcctaatttattaaaaccagaacatttgaaatctatgtctgaaaatcctatagtatttgcattatctaatccagatccagagatcaatcctgaactagctaaatcagttagaaaagatataattttagcaactggacgttctgattatcctaatcaagtaaataatgttttatgtttcccctatatttttcgaggagcattagatgcaaaaataaaaaaaattacctattctatgtgttttgcagctatagaatcaattagaaatattgcaaaattaccaattcctaaaactatgattcatttatatccagatattaataatattaattttggaagagaatatttattacctaatccgatggatcctagattaaagaaaaaagtttcaactgctgtttttcaagcagctcttgcatctaatataattagaaaataatatattttttatatttatactataaaatggttataaaaaagagttctaaattttaatttaacttaggaaatttaataaaatgtcaaaaaaaaaaattgctattattggatcaggaaatatcggaggaacaattgctcaattaatcttatttaagaaattaggcaatattatattatttgatataattcaaggaaaatctcaggggaaagcattagatttattacaatgttcccctatcgaagaatttaataatacaattattggttctaatgattattctgacattcaaggatcagatattgtggttgtgacagcaggaattacaagaaaaccaggtatgaatcgaaatgatttattattatataatggtaacattataaaaaatataggagaaaaaattcgaaaatatgctcctaatgcttttgtaatttgtattacaaatcccttagatactatggttagtttattacaacatttttctcaaatttctgacaaaaaaattgtaggaatggcaggtatattagatactgcgcgttttcgaacttttttatctttagaatttcatatttctatcactcaaatacatgcctatgtattaggcggtcatggtgataccatggttccattaattagctcaactaatattgctggtcaaagtttaaacaacttaattaaaaaaggaataataagcagaaaaaaaatagataatatcataactagaacaaaaaaaggaggaggagaaattataaatttcttaaagaaaggttctgcattttatgctccttctagtgctacagtacaaattattgaatcttatcttgaagataaaaaatatattttaccttgttcagctaagataagaaaaggagaatatggtattaaaaataaattattttttggagttcctatttgtataggatctaaaggcattgaacaaataatagaaattcctttaaataaacaagaaaaaatagatcttcaaagatcagtagatataattagaaaaaataatgttgaatctgataaaatttttataaaatctctttctaattagagaaaaattattttttaaatatttttatataaagattataaattataataaaagtttattgatataatagatttaggatatttaatattattttttgatgttatagaaaaattattttgataataagaatattctaatctagaattaatattggaaatccaattaatattaattccaaaaccaatatcataagatatataactattatttatagaaaaaggtttattatatttaatatagtatccataattataactgcctccatatcctatttttccatataaactaaatatatattgatattttataattataggaaacattataattccatgaatatggaatatataaatttcaatttttgagaaaggaataatagaagtcctagtttttatataattttctagcacactaatcctatctgcattaaattctatatttatatatttattaaatttatatccagaaaaaattccaaaatctaaacttttatagaccatccaatttcttgtatctatatcaatagacggtataacatggccaatattcacacctatatatggtccttgattaaaatttttactttttaaaaaaatattctttctagataaagaaataagattatttccgtatatatttattgttagaaaacaaaaaaatattatagaattttttgctattaattttaacattattaaatgtctcttaaatattatttaattataaataaaaatgataattacattattatacccccccccaaacatttttcttttaaataaagtaccacagattgtccggaagttatagctctctgtggttcatgaaatattacttcaatatttttttttttcactaaaactatacatcttttatcattttgttgatatctaatttttgcattacaaaaaaatttacttgatgggggatgccctgaaatccaattaatattatttgccttaagtttttttttatataatagatgatttttttcgccttgaacaacaattaattgattttttttaatatcttttttacttacataccatgcatcttcagaaaaatttttatttccacctatttttaatccctttctttggcctatggtataaaacattaaaccctcatgttctcctattttttccccagatgttgtgattatatctccaaaatttttagtaaaaaatctttctaaaaattttttaaatttattatgaccaataaaacaaattccagtactatcttttttttttgcgttaataaatccaagttttatagcaatatttctaacttccttttttgtcatattcccaacaggaaatatagaactatttaattgtttttgggataatgcataaagaaaatagctttgatctttttttttatcaaacccttttatcaattctatataattatttttatttttaataattcttacataatgtcccatagctattttatctgctcctaaactaagagcatattgtaaaaatattttaaatttaatttctgaattacataaaatatcaggatttggagtgttgccatttttatattcagataaaaaaaccttaaaaacatattcccaatattcattggataaattaattttttttaattcaatacccaaatgttcacaaacaatttccgcatcttttaaatcacgatgaactgaacaaaattcttcatcatcttcctcccaatttttcataaaaactgcttttactttataaccttttttcaatagtaaatatgcacttacagctgagtctacacctcctgacatgccaataataattttagacatcaataaaattttaaaaaaattaataaactataaatatatgatatcaattataaatatatattgtaatatataaaatcaataaaaatattattcaaatttatatttaaattattatgtatttatgttagaactaaaaaatttttaaaattaaatacatattatttttatgttaaatatctaaaatagatgaattataaaaatattaaaattccacaaggatataagattatacagtctcaaaaagaaaaaatagttgttccagataatcctattattccatttattatagaagataatactaatattatacatttaattgtaaaacaattagtaaatattgcagtaaaaaaagcttatgataataatcgaaaaatatcttggatggatatatatcttggaaaagaatcagaaaaaaattatggaaaaaatatttatttacctgatgaaagtataaaggctattgaagaatttggcattgcaatcagaggtccttcaaaatatatttactcttcagaaaagagtatttattctataaatttttcattagaaaaaatacttaatttgtatatatgttgtcaaaaaatttattatttttttggtgtaccaagtactattatatctcctcaaaatattaatatgacaattttccaagaaaattcagaagatatatatactggaatagaatttcaatcaaatagtttaaaagcagaaaaaatgatcaattttttacgaaaagaaatagatataagaaaaatttcttttacagaacattgtggtataggattaaaaatttcttctagacctgctgttaaaagaataatgaattatgctattcaatatgcaataaataacgataaaaaatccataactttagttcataaaggtgatattatgaaattcactgaaagtgattttagaaaatggggatatgaatttgccaaaaataaatttaatgcaaaatttaaaaaaataaaaaattattttgaaataaaaaatccaaaaacaggaaaaaatattatattacaagacattttaatagatgattttctgcaatatatgcaaatttcaccagaaaaatatgatataattgttgcatcttatttaaatggtttttatatttctaaaatactatcttctcaaataggatttggtacattatcatccaaaatatttttagggagaaatattgttatttttgataattcttcgtcatacaaaattttactaaaaaaaaatattgatataaaagataatccaattccaattattctatcttctatagaaatgcttcaatatattggatggaatacttctgctgattttttaatgaaaggattatctaaattcttaagtaattctgaaatatcttatcaaatatctggaataaaaaaaaatttaataccattaaattctaatgaaattgcaaaacatattatacaaaatatatagtacttttattttatttgtttcgaaatataattcttcccttagttaaatcataaggagaaatttcaacagtcactttgtctccttttaggatacgaatataattttttctcatttttccagatatatgtgctattataacatgattattttctaattgaaccttgaatattgtatttggtaaactttcaattacagttccttcaacttgaatattttcttcttttgccatattttactttaaaataaattaatttaaattttgaatattattcaattaaatatttttagaatagaaattatcatgtagaaaattttataaaaagcaagaaaaaattattaatttttattttattatcgataattttgatttttataatatattttttaatttttaaaatatttttttgggtatttacaaagttttcctattgaacaatttacacatttaggttttttacttttacatatgttttttccatgtaaaactattaaatgatgaaaatcttttttaaaagaatatggaactaatgataatagaattttttctactatctccggatttttttcttttacaaatccaattcggttgctaactcgaagtacatgcctatcaacggctatagttggttgctcaaaaataatatttaaaataagatttgctgtttttcttcctacaccaggcaaagataacaaatcttcttctgaagaaggaactgtacttctatatttattaactaatatatgacaagtttgcattataaaatttgctttatttctatataaaccaacagttttaatatatttttgcaatttattaatgcctaaagaaataattttttcaggagaataagcaatagaatataatttttttgtaattttattaacttgaatgtcatttgattgggctgataaaattattgaaattaacaattcaaatgttgaattatattttagtccagtattaggtttgggatattctttttttaatttttctaaaatagaaaatattttttttttattcataaggaatttattttttctttatatctttgacaagcatttttgataaatttttttctttcgttttgtttaattttagtattttctaatacattatattttttatattttttattttgtaaatatattttttttgcttttcttagttttttttctttatatcgatttttaaatatttttctttgaatttcttgataatgatttgattggcatttatccctaaaataggatgaaggagtcatataaatacaatccattggacaactttttaaacaaagtttacaacctgtacattcttgtgaaataacagaatgcatcattttttttgttcctataatggcatctacaggacatacttctatacatttcatacaccctatacatagatcttctttgatagttgcaatactatattcttcatcagtttgattaaaagatgatatttttttattcaataatttcgctaatgattgcattactttttgtcctcctgttttacatttatttatttcagcttttttatctacaagagcttttgcataagatttgcaatctttataattacaacgtttacattgtgtttgaggtaatttagaatcaataagatctattaataacatttaataattcaatttcaaaatatattattatatttatttttattaaaaataatcaatccatttctagaaaatgtctatataattatgttattatgaaattgtaatgaatttctttaattttaaaatttaggattgcaaattatgcaaattaaaaaaatttatcaaaaattaaaatttttaaaaaatagattatacaatttacggaggcatctttaattttattagtcagaaagaatatttaaaagaattaaattatgaattatcattaccaaaaacatgggaaaaacaaaaaaatatttcttttttacaaaaagaaagaaattctgtagaaaaaacaatatctaatttacagaatattaattctgatattcaagatattgagacacttctaattttatcgcatgaagaaaaagatgaaagtttaatacgagaatctgtgcatgaaatagaaaaaatagaaaaaaatatttctgaattagaattttcttctatgtttagaataacagataactataatgcttatctagatattcaatctggatctggaggaattgatgcacaagattgggcaagaatcttattaagattatattttaaatggggaatatctcacaatttttttccaaaaattatagaaagtacttctggcgatatagcaggcattaaaagtgctactatatatttttcaggaaactatgcttatggttggttaaaaacagaaactggtattcatcgtttagtacgcaaatctccttttaattctttaaatcgtagacatacttcgtttgcttcaatttttgtatcaccggatatttctcagaataaaaaattatatgtcaatatcaatttatctgatttacgaattgatacatatcgttctaaaggggcaggaggtcaacatgtaaatcgaactgattctgctgttagaattacacatttaccaactaatacagttgtacaatgtcaaaataatcgatcacaacatcaaaataaatcacaagctttaaaacaattacaatctaaattgtatgctattttattacaaaaaaaaagtaaagaaaaagaaaatattgaaaaatctaaattagatatttgttggggtaatcaaatacgatcctatatattagatcaatctcgagttaaagatttaaaaacaggaatagaaacaaaagatgttcaatcagtattaaatggaaatattgatcaatttattaaagctagtttaaaagaaaaattataaaaattttttataaaatattttatttaaattatttagcatgagaaaattctgttttatcaattttttcaaatctagaagatattttttttgccgaaatataaattgattctatatctttattgattaattggatatgactttgaagattatccattctattttgaaaacgaataaaatcttttgcaagaaaatgaagatggtcttgaataatatgtacttgttttcgggtagaatggtcttttaaaacagaacatattgtcgttaaaattgccatcatagtggttggtgatgaaatccataccttttttctatgagaaatttcaattaatccgggataataagaataaatttcagaaaaaatagattcagaaggtataaacattattgcactatcagcagtttctccaggtacaatatatttttcagaaatatctaaaatatgttttttaacatcacgttggaattgttttttaaatttttttttttctatttcaggaagattatgattggatattttttgataactttctaacggaaatttagaatctacagcaatatttcctgtaggttttggaagaaataacatacaatctacgcgttttttattacttaatgtgtattgtaatttaaatacattttctggtaatacatttttaattaacatagataattgcatttcgccaaaagcacctcttgaacgtttatcagataaaatttctttcaaactaattatattttgagataattcaattaattttttttgtgattcatcaagaacagctgtacgttccaaaatattaataaaagtattttgattttttttgaatcctttatataaactatcttctacagtcaaagaaatattttttaaattattatttgtattttgactaattctatttaattggtctgcaagtattttataattttcttgtacagtatgttgtaaatttttttcttgttctctgataccttcttgcaattctttgtgaaaattttttatattttctatatgaaaagtggataattgtaataagatttttttttctaaagcaagataagtttctcgttcttgaaatttaaaaaaaattattgctataaaaaaaaataatattactaatataaaaaaaatataaataaacactttacatattttctattgtgaaaaattcaatgtgaacaattgtattatttttaaaacataaatgtaaatatataaattattcatacaaaaacttgcgtatattcgcttaaagggtatcataaaatataaaaaaatttaggatattttatgtatgtacaagcatatgttagtaattctagaaaattaatttttgataaattagaaattttattaaaaaaaaaattaaattttttagaagctaaatatttatcaatttttatgaaaaaatattatgctagtgcttcagaggaagatttaaacagtcgtagtatttcggatttatatggaggattaatttcgcaatggaatttattgcaaaaaagaaaaactaaggaagcaaatattaaaatttataatccatcttttgaagaaagcggatggaattcaaatcgtactataattgagatatcttatgatgatatgccttttattgtggattccatattattatatttaaatagtattgaagtaaatatatatgttgtattccatgttggaggtctattaatttatagaaataaagtagggaatcttcttagtttatatcaagaacaaaatatttctaaaaattcttttctttttactgaaacagcaatttcgatagaaattagtaaacaaaataatcctataattttaaataaaataaaaaataacatatcaaatacattaaataatgttgatatcattgtctcagattttgaaaaaatgaaattttttcttgaaaaaacaataaaaaatttaaaatataattattataattttccaaaaaaagaaattttagaatcagttgattttttaaaatggttatataatcattttatttttattggaagtggaaaatttataagatataaaaaacaaaataaattatcgtttcaattggtttcatctagtaatctaggactattaaaaaaagaatcatttttaaacgaaaatattaaagaaatagaaatgttagaaaatatttcatacgatttattaaatcctatttctattataaaatctaatcaaatatccacaatacatcgatcctcccattttgatataattagtgttaaaaattttagtataaaaggagaaattttaggagaaacacgatttatagggttatatacttcaatggtataccataatagttgtcgttatataccatttttgcgaagaaaagtagaatctgtattatttaaatctggattttcccaaaatggacatgatgctaaagcattaataaatgttttagaaaaatttccgaaagatgaattatttcaaatcaatgaaactgaattataccaaatatctatagaaatattacaaatccaagaacgtaaaaaaattaaactttttgttagaaatgattcttataatcgatattattattgtataatatattttcctaaagaaaaatataatacaaatattagaaaaaaaattcagaatattttattaaattcttttaaaggaatttcttctaattatataccaatttttttagaatctgttttatgtcgcatagattttattataaaagtagatcccaatatatcaaataatattatttataatataaaagatattgaattaaagattatagaagctacctatagttggaaagataaatttaaaaaaaatttattaaaaaatagaaaaaaaattaaaagtttaaagttatataaaaaatataaagatgcatttccattgggatatcgtgaatttttttctatagaagttataatagatgatatatttaaaattgaaaattttttagataaacaaaaaatatgtttttctttttatcaaacattatctgatgataatgttaatttaatacgatttaaaatgtttcataaaaatgaaatattaccattaaccaaagttcttccagtatttggaaatatggggctaaatatagtagatgaaagaacatataaaatattaccatataataaaaaaatttggatttctgattttggaattaaaaatgattattctttatctttaattaaagaacgtcttatagaatttcaagatgcatttttcaatatatggattggaaatgctgaaaatgataagcttaattttttagtaattcaaaaaagaataaaatggcgtgatattgttatttttcgtgcatatacaaaatacttaatacaaataggttgttcttatagtcaaaaatatattgaaaatgcaataattgatcatgcaaatattgcaaaaaaattaataaaattattttatataaaattttctccaaatttttttaacgaattttcttttcaagaaattaaaaattatgaaaaaaaaatttgtaatttaatatctcaagtctctattatagaatatgataaaattttaagaaaatttttaaacttatttaagtctactgttagaacaaatttttttcaattagataaaaataaaaattttaaatcttatctttctattaaatttgattgtacaaaaattgaaaattttcctgaaaaaagagttatttatgcaatttttgtttattcgcctcatattgaagctattcatttaagatctgcaaaaatctcaagaggaggacttcgttggtcagatcgtcatgaagattttcatactgaaattcttgggctaatgaaggcacaacatattaaaaattctgttatcgttcctttaggtgctaaaggaggatttatttgtaaaaaaataaaaaaggcttctcataaagattttcttctagaaggcatatattgttataaaatatttatttctgggttattagatttaaccgataacattatagatggaaaaattattactcctcctaatcttaaatgttttgatgattctgattattatttagtcgtcgctgctgataaaggaactacaacattttctgacattgcaaataatttggcaaaaaagtataacttttggttaggagacgcgtttgcttctggaggcacttatgggtatgatcataaaaaattaggaattacagcaaaaggtgtatggaaatctattgaaagacgttttttagaaatcggatatgatataaattcaagagattttactgtagttggaataggagatatgagtggagatgtttttggaaatggaatgttactatctaatcgtattcaattagttgccgcttttaatcatctacatatttttattgatcctaatccagatcctctttcttcatataaagaaagagaacgtatatttaaattgccaagatcaagctggaaagattataatgcaaatttcatttctgaaggaggaggaatttttaatcgatctgataaattaattcctatttcaatgcaaatgaaaaaacgattttacattacagaaaaaatgcttgaacctaataaattaatacaatttatattaaaagcaaaaatagatttaatttggaatggaggcattggaacttatatcaaagcttcttatgaaaataataatgatgttgaagaccgtgcaaatgatgcaataagaatttctgcaaatcaattaagatgtttagttatagcagaaggaggaaatcttggattaacccaaaaaggtcgtattgaatacgctttaaaaggcggaggtatttatatagatgcaattgataattcggctggagttgattgttctgatcatgaagtaaatattaaaattatattaaaaaaggcagtagaaattggaaggattagttttatagaacgtaataatttattagaaaaaatgcaagacgaagtagttcaacttgttctgtctaataattacgcacaaactcaaattattagccgtatgtctattgatgggaaaaaagagataggaagttttattcgattaatacaaaaattagaagaaaaattttatttcaaccgtattaccgaatccttgcctagtaaaaaagaaatgaaaattcgaaaatccactgggaagggattaacaactccagaaatctctgtattattagcatatacaaaaatcatgataaaacaagagttattaaaatctaaaatttataaagatccatattgtaaaaaatttttaaaagcagaatttcctgttattctttctgaaaaatttgaagatttgatgtctaaacatattttagcttctgaaattataattactacacttactaattttattattcaaagaatgggtattactttttttaatagaatgtatgatgaaactggtgctaattcagaagaaatagcaaaatcatttatcgttgtaaatgaattaatacaagttgacaatatttggttccaaatcgaaaaattagaaaaaaatatttcttataaagcacaaaaatatatgattttagaaattactaaaataaaacgtaaattatgtcgatggtttttaaaaaatcataaattaaaatgtagtattcaaagttctattaattcttataaagaaaaattgaataaaataaaaattatgatacccaatatgttaggcaaatatgatttagaaactcaaaatcgatatatacaagaatgcaaaacgcaaggaatacctacctctttatctttagaaattaaaaatatttcttatatttcatattgtttagatattattgaaacagaaaaaaattttaatattgtattatttgaactattagaaatattttttttattaaatgaaataatgtcattttcatggattagaaatactttgcttaaaaaaaagtataatcaagaatattggaaaactttagctatatcttctatgcgtgatgatttagatcatcttcaatgtgttattgcaaaaaatatttctttacttaataagtataatacttctaaaaaaaaaattgataaatggatacaaataaatttttctttggttaaacgctggaatgaaatgattgaattattaaaaactaataattcacaaaatatggttcttttaattatgacatttagatctctgttagatttaactaactaattttaaaaaagcaattattcccattcaatggttgcgggtggtttattagtaatatcatataaaaccctagagatattgctaatttgattaataatagcttgagaaatttcttcaagaatttcataaggtatttgggagatatttgcagtcataaaatctatagtttttattgctcttaaaacaataatatattcatattgtcttttatcaccgataatgcctactgactttactggaagaaaaacagcaaaggcttgattaattttttgatataattcttttttttttagaatttttataaaaatataatctgctttttttagtatttttaaatatttaattttaaattttccagctattcgaatagctaatcctggaccaggaaatggatgttgataaataaaattatctgataatcctaataatttggcaatagcataaacttcatctttaaacaaattttttaaaggttctaacaaatataatttcatattttttggaagaccgcctacattatgatgtgatttaataacttctgctttattagatatatgattttttttggcagattctataatatcaggataaatagttccctgcgctaaccatttaatattttttttatcagcttctttttgaaagatttcaataaataattttccgataatttttctttttttttcaggatcgctaacaccatcaagtttttctaaaaatttttttttagcatttatatatataatgtttaactttaaagttttattaattttttttatttcttcttcttgttttatacgtagaagaccattatttacaaaaatacatattaactttttttcaatagctttttttataattaaagcggtaacaagagagtctataccaccagagagcccaagaattaccttatttttttttatttttttgtgtacacccttaataaggttttcaacaatattcttttttttccatgttcttgtgcaatttgatatatttaaaaaattttttaatatgctacttccatattcggtatgactaacttcaggatgaaattgaattccatagaaatttttttttctattttcaatgatagtataaggagaatttttagtggaagcaattttttgaaaatctttaggaattttaataacattatctgtatgactcatccaaacttgaaaaaaatctttaggaatatttttaagaataggagattttttatatatttgaactatagtatttccaaattctcgaatatttgctttttctacttttccatttaattgaagtgttaaaatttgcataccataacaaattcctaaaataggacaatgcaaatcaaatacaatattgggaatagaatatctgtttttttggtatactgattttggaccaccagataaaataatacctttaggagaaaaatcttgtattttctctttgggagaatcataagacataatttcacaatatacacctatttcgcgtattttccgtgcaatgagttgagaatattgtgaaccaaaatctaaaattaatatcttattacttgtaaatatattttttttatatatattcattttttaatatctttgatagtttggagattcttttgtaatattaacatcatgaacatgactttctcttatacctgagttagtgattcgaataaaatgagattgtgtgcgaagtacattaatattagaacttcccgtataccccatacctgattttaaaccacctataagttgataaattacttttttaaccgatcccttataaggtattcgaccttcaattccttcaggaactaatttttcggtataattatcttcttggaaatatctatcgctagatcctttcttcatagcagataatgatcccattccacgataagatttataagaacgtccttgaaataattccatttttcctggagattctttagttccggcaaacaaattgccaatcataacactatatccaccagctgcaatagctttgataatatctcctgaatatcgaattcctccatctgctattataggaatattataagatgataatgcatccgaaacatttgaaattgcggtaatttgtggaactcctactccggatataacacgagtagtacaaattgaacctggaccaatacctactttaattgcatcaacacctgatttggcaagagcaacagctgcacttgcagtagcaatatttcctgcaatgagttgaatattaggataattattttttatccaagatatataatttattactctttccgaatgagcatgagctgtatcaataacaattgcatctattccttcagaaattaatgattgaactcggtttttactagaatcatctattcctatagcagctcctaccattaatctgccatctttatctttgctagaaaagggtttttcttctgcatgttgaatatcgcgaacggttattattccttgtaattttttttttctatctaaaactaatattttttcaattctgtgtttatgtaaaagatatttcacttgtgcaagtttttctccctcttgcacagtaacaagtttttcttttggtgtcattaacgacgaaatttttttttctaaattttttacaaaacgtatatctctattagtaataataccaattaaattagcatttttaacaacaggaagtcctgaaaaatgatatttttttgtaatttttattaaatctcttacagtattttctggattaacagtaataggattttttacaattccacttttaaattttttaacttttttaacttccaaaacttgttcattaatacttaaatttttatgaataataccaatacctccttcttgagccattgcaatagcaagtttactttctgtaacagtatccatacctgctgatattaaaggtatatttaatctaatttttttagtaaaaaaagttttggtagaaacatttttaggtagaattttgctatatttaggaagtaataaaacatcatcaaatgtgagaccttcttcaattatctgaatcatatattttttttaaacattaatgaaataaaattatgacattgaattatcaagaagtctatttaagaatcaaattcttaataattttaattaaaaaaatataaatttctgtaatattgaaaaaaaattagtaaaattactttaaatctatataaaaaaaaaatatatggttgcaaaaataattgatggtaagttgatttctaatgaaattaaaaaaaacataaaatatgaaattcaaaatcgattacatataggaattcttcctcctggtttagctgtaataattgtaggtacagatcctgcatctttgatatatattgaaaataaaaaaatagcatgtcgagaagttggtattaattcttatcaatttagttttccttatcatgtaaaagaaaaaactttattaacattaatagaaaaattaaatttagataataaaattgatggtattctagtgcaattgcccctgcctagtcatattaatgaacataaaattattgaaaatattttttctaaaaaagatgttgatgggtttcatccttataatttaggattattagcacaaagaagaccttatcttcgtccttgtacctctaaaggcattattactttattaaaaaaaaccttaaaaaatgatatttctggatttcatgctgttgttataggagcttcaaatcttgtaggaagacctatgtcgcttgaatttttattagaaaaatgcacatctacagtatgtcataagtttagtcataatattaaaaatattgcaaaaaaagcagatattttagtatcggctgttggcattcctagaattataactgcagattggattaaacctgatgccatcgtcattgatgttggcattaatcgacttgcaaatgggaaattaataggagatgttgattattatcctgtatctagaaaagcaagttggattacccctgttcctggtggagtaggcccaatcacagttgcgactttgcttgaaaatacattatttgcatctaaaaaattaaaaaaataaaattttatttttaatattaattttaaaaagttacatattaataataacttcgttctccacataaattttttttaaataattttataattttatccttattaatttgcaaagaaaataaataaaaaatttttgtaatgacagcttcaaaagtcatatctcctgcactaattatattagttatattatttattttatcagatacagcatattttttgctattaacatagccatgttggcattgtgatatattgataattaaacaaccatatgcagcacatttttttaataaagaatataatataggtatattatttggaacattgccacttccaaatgtccttaaaataatcacttggggtttaatacaaaaaatatatcgtatccaacgtaaatcaatatttggaaaaaatgtaataactattatattaacatttttaaattttttaaatttagaaaatacaatatctcgaaaaggttttaaccctttctgaaaaataggattaggtacaaaaaaagcatcatttgatatattactatattttgtacttctatttccttgtaaaagttttttatgaaaataaatataacatccttttttaattttcattattatttttagactttctaataaatttttatgtccatctttataggttttagaaataggaaattgagatccagttaatattataggttttttgaaataataaaatacataagataatgctgacgcagaaaatgataatgtatcagttccatgaataataataaaaccatcataatatattttattttttttaataattttgataaaattattccaatggcatatattaatgtttgaagaatctattaatggatttatttgtaatatacgaaaatatggaatgtttttttctttaagttctatatttttttggatatatttttttaaatatctggagtctggaacaagcttattatttttttttttcattcctattgttcctccagaataaataattagaatattcattataaaatttcccttaataatattttgtatattttattctaaaaaataatgttattatatttattatgtttttcttcctctcgcaaagttaatacttcatatccattttctgttactagtatagtatgttcatattgtgcagataaagatctatcttttgtaacaactgtccaaccatcaggcaatgttgttgtaaaatattttcctgcattgatcatgggttctatagtaaatgtcattccttcttttaatatttctccagttccttccactccataatgcaatatttgaggatcttcatgaaaatcacgaccaataccatgtccgcaaaaatctctaacaattgaaaatttatgatattctgcatatttttgtatggctgatcctatatcacctagtctagctcctggttttacttttttaataccttcccacatagctttataagtaattttagataatttttttcctaaaataggagatttatcaaaaaaaaacatcttactagtatctgcatgatatccatttttaataatagtaatgtcaatattcaatatatctgaattttttattattcttttagaaggtataccatgacatactacatgattaatagaaatacatatagatttaggaaatcctttataatttaatggggctggtattgcatgaattgtatttgtaataaagttatgacatatcttatcaagataatttgttgtaactcctggttttacatatggttttatcatcgataaaacacttgcagctaattttccagaaattttcatctttttaatttcttctaaagattttatttttatgaacataagtaaattttattgtacttttttatatacatatgctataaatcgcatcttaatttagcaaattatttgtataattttttacgaaatttaaaattaagtaaaaatttttaattttttaatatgaaagaatttttttctttataaacagaggataaataaaatatgtctaaactttctatgcgtgatatgataaaagcgggtgttcattttggtcatctatcacgttattggaatccaaaaatgaaaccgtatattttcaccaaaaaacagaaagttcatattataaatttagaaaaaacaattcctatgctatcaaaagctatggattatatagctgatatagtattaaaacaaggaattatattatttgtaggaacaaaacgcgctgcaaaacaaattttaaaagaagaagctataagagctggaatgccatatattaatcatcgttggctaggtggaatgttaacaaattataaaactattagaaaatcaataagacatcttaaagaattagatcaaatggaaatagatggattatttgataaaatgcttaaaaaggaagcattaaaaattcgtcgtgttcatcaaaaattacaaagaagtttttctggaattaaaaatatgaatgggttgccagatgctttgtttgtcattgatagtaaacatgaaaatatagcaataaaggaagcaaaaagattaaatattcctgttataggtattgtagataccaattctgatcctgattatgtagattatcttataccaggaaatgatgacgcaactcgtgctattcgtatttatttaaataatattgctgatattatcattcaaacaaaagaaatttcccatcctttaaaggaaaataaaaaaatttttacaaatcctattattaaagaaaaaaaaaatatttttttaaaaaaacaaaataaaaaaatattagatataaaaaaataattttttatttttaaatattttaatatttgatcctttgtaaatatttaaaattaacctataggtatacaaaattatgaaattaatagaagaaataaaaaatcttcgcaagcgtactggagtaagtataatcttatgtaaagatgctttatacaaagctaatggtgatatagaaaaagctttgcaaataatttataattctgaaaagtataaatctgttcaaaaattatcaaaaaaaacagatgaagggattatttgcctagaaatgtctgaagacaaaaaaaaaggtgtgatgattgaagtaaattgcgaaacagattttgtatcgcgaaataaagaatttttaaattttgcaaagcaaattactaaaaatatactaaatagcaaaaatcgttcatctgatatatcttacttactctcaacagaattaaaaaataaaaaatctattgaagaatatagaaaagaattatcttttaaatttaaagagaacattaaatttaaaagagcaagtatttttcaaactaaaaaaaaattaggaggatatatccatagaaatcgaattggtgtattagttgaattagaaaattccaatccatatatttgtcatgatattgctatgcatatagcagcaatgaatccatatgtaatagatattaatgattttccgttaaaagtaattgaagaaaaaagaaaaaatttttttcttgaaattaataaaaaagaaatatctgaaaaaattaaagagaaaatagttttaggaaaaataaataaatttttaaatcaaaatagtttattacagcaagattttataaaaaatccaagaataaaagtattagattttttaggtaaaaaaaataaaatattgcgttataaaagatatagtttaggagaggatataaaaaattcttttatacccttttaaatttaaagattattttttcaggttagaaaatatgtttaaaaaaaaaaaatctagagttttattaaaacttagtgggaaggcttttgcaggaaaaaatcttcctatttcagaagataaaattattttttgtgttaaacaaattgtagaagcatataatcaaggcattcaaatttgtattttggtcggaggaggtaatttttttcaaggaaaaaaaaaatcccctaactctcttatttcacgtattacatatgattatatgggcatgacaagcacacttattaatggactagcattaagagatattttaaaaaattatcaaattaaatctaaaattttttcttctatttctattaatggtattacagaacatttttcttcttttatcgtagaagattatattatacatggaggaattggaatctttgtttttggcactggaaatccattttttagtactgatactgcagcaagtcttcgaagtatagaaattaatgctaatgttttattaaaagcaactaatgttgatggtatttataataaagatcctaaaaagtacaatgatgctattctttttaagaatatatcttttgatacagcattaaaaagaaatatatctgttatggatgcaaatgcattttcccaatgtaaagattacaatattcctattgttgtgtttaattttcaaaaaaaaatggcaattaaacgagctttattaggtgaaaaagaaggaactcttgtgaattttaaaggagaataaatcattttgattataaatattttaaaaaaaacaaaacatcgtatgaagaaaactataaattcttttcaaaatacattagatactgttcaaataggacgcgctcatcctaaaatgcttgaaaatatttcattagaatattatggaaacatggtacctattgcacaggttgcaaccattacgataattaattatcaaacattatctatttctccatgggaaaaaaaaaatcttgtaaaaataaaaaaagctattttagttaaaaatataggtcttaatcctgtaatatcagaagatatagtattagttcctatccctccattaagtgaggatagaagaaaagaaatgattaaatttatatataaagaagcagaaaaatttcgaatttcattacgaaatattcgtagagacactaaaaattatattaaagaattaattagaaaaaaaattttttcagatgatgttttgtattcttctgaaaaacaaatacaagatcttacaaataaatttttagaagaaataaataatcttattgatataaaaaaaaatattttgttaaaaaaatgattttatttgaaacaaaataataggtatttagaaaataatgtttctaagaattttaacgggaataatattacttatattatctataatattttgtttttttattccaaataatatttttaagtatttaattgatatattttttatgatagctatatatgaatgggcaaattttattatatccaatctatatatacgttttatatatgtaatatcatattttttaattataaaaaatttaataatatttttttatcctataatatatttatcattaatatggtggttgttaataggatttatattaatatatcttcctttaaaaaagatgatttttttaaaaaatcctgttgtatattttttgataggattatttttattcacgcctgcatggttgtctgtaattaaattatatttacgtaacccatggtttatttttacagtaattttttatgtatcattaaatgatagtgctgcctattttattggttcaaaatggggatatactaaattatctcctacaataagtcctaataaaacatttgaaggtttttttggtggtatatttttttcattatttttaggaaaaatcatattttctatattagaagtaacaatatataaaaatatattttggatattattatttttaataactgttttatttgcaaatattggagatttatttgtaagtatgataaaaagactttttaaaactaaaaatagtggttatttattaccaggacacggcggtttattagatagaatagatagtttatgtgcagctcttccatttttttcttttagtatattttttttaacgaaaaaattctagaatttatttcttagaatttttactagaaaatatatagtgttctaaatatagaatattatatattctaatattagatagtattagtacttttcaattttaatattaaaatgataagaatagataaaaaaaacgcaattcttactaaagaatttaaatcttttgacatggttactcgacctaaatattttgttgaatataaaggacaaaaaaatatttgtaatcaaatgaaaatttttattcatgcagcaatgtctagaaaagattctttagatcatacattaattttaggttctccaggtctaggaaaaacaacattagctaatattatttctaatgaaatgggtgtttctataaaacaaacatcaggtccaatcttagaaaaaccgggtgatttagttgctttattaactaatttagaaaaaaatgatgtgttatttattgatgaaattcacagattaaaatcttcagtagaagaatttctttatccagctatggaagaatttaaaattgatatattaattggagagggtatagggaaaagatcagtaaaaataaatttaccaccatttacattaataggtgctacaactagagattatttgctaacaagtccattacgtggacgttttggaattattcaaagattaggattttataacgtagaagatttaactcaaattattatgcaatcatctaaaatattaaatataaatattaaaaaagaagcagcagaagaaattgcaaaaagatctagaggaactccaagaattactaatagattattacgacgtgttcgagattttgtagaagttagatttgatggaattctttctaaagaaacagtaaaatatgctctaaattttcttcaaatagattcactaggattagattatatggatcataaaattttatctactataattcaaaaatttaacggaggtccagttggattaaaaaatttatcaatagcagtaaatgaagataaaaatataatagaagaaattatagaaccttttttaattcaaagaggatatattatacgcactccaaaaggacgtttagttactaacttagtatatcaacattttaataactattttccttttattcaaaataaataaaattattgtttatataaatttaaaaaaattacataaaaattataatgacatattatctatgaaatgagaaaatatatcttttaataaaaatctttattttatgaattattttaaaaagaactttattgacaatatttctgttcttcctcattcgattaatgcagaacaatcaattcttggtattttaatgattgaaaataatgtatggaataaagtttttcaaattattgatagtaatgatttttacattaaaaaacataaaattattttcaatataatttctcaattagctgaaaaatctaaaccttttgatataattaatatttcaaattttctagaaaaaaatgatgaattaaataatattggggggtatgcttttttaaaagaacttactgatatgataccaagtattcgaaatatttcttcatatgttgatattgttaaagaaaattcaattttacgtaatcttattatgacttcacgtacaattgcaaataaatcttattatcctggtacaaaaaatagtaaagaattggtaaataaagcagtagaattaatttcttcaattgctaaaaaaatttcttttgaaaagagttatcctgtaggaattaaaaaaattgtatctaatataaaaaaagattttcaagataaaaaaaatattaaaaatagtaaaattagtggaataaaaacaggatatgatgcgattgataaaatgacatcaggttttcaagaaggtgatcttattattattgcagggcgcccttctatgggaaaaacattattatcaattaattttgcagaaaatattgctttgaactcaaaagatcccgttttaatttttagcatggaaatgtctaaagaatctttagtgcaaagaatactttcttcgcttagtcgtatagatcattcatcaatacgtaataaaaatcttaacaatcaagaatggaataaattatttaatgaaaccattcccaaaatagaaaatatgcaattatatatcgatgatacaccttccttgactccttttgagttacaatttcgagtacgacaatttatatatgaatataaaaatataaatttaattataattgattatttacaattaatgaaaatttctgatacattccaaaatcgtaattatgaaatatctgaaatatcaagaaatttaaaagctttagctaaagaaatgaacattccaataatagttgtatcacagttaagtcgaaaattagaaattcgtgaagaaaaaagaccaataaattctgatttacgtgaatctggtgcaattgaacaagacgcagatgttattatgtttatttatcgtgatgaaatgtattatgaaaatagtaaagataaaggaatagcagaaattatatttggaaaacaaagaaacggtccaacaggaaaaataaagttaacttttactggcaaatattgtcgttttgataattattattctggaaattattctccttcttcatattatatattataatcatatatatgaaatatggtgctatttattttaaataattattattgattataaaataatactattaaaaaaaattattttagtatttatacttgttaatctttaaataaaatttatatttttattataataattattgtatttttaaataataaaatttaaaatttttagattgaaaataaagaaattatagcgtctgtagctcatttggatagagcaattgccttctaagcaataggtaggaggttcaaatccttccaggcgcgccaaataaaatatagtattttgtggtgaacgtagctcagttggtagagccccggattgtgattccggtcgtcgtgggttcaaatcccatcgttcaccccaatttattttaataaaaccattataaaaattgcgaaagtggtggaattggtatacacgctggatttaggttccagttcttttaaaagtatgagagttcgaatctctcctttcgcaccatatctatataaaaaatattaaaattattttctatctagactttttttgattaaatgcataaaattatttttatattttaattaaacactacatatcatttagatataatataaatatgcaagtttctatagattcttattcgaaaatatataaaaaaattcttttttctattcctagaaaatatattcaagataaaatacaaaaaaaaataaatagtatttcttcaaatattaatatatctggatttcggactggtaaggctccgaaatctattatacaaaaatttcatggaaatcatttacaaaatgatgtaatccaaaaaattataaaaaataatttatataaagtaattgtcgataataatattatgattatagggtctccaaaaattactattaataaaaatactaaaaatagtgatttagtattttccgcaattatagaaacatatccttcagttaattttgatattaaaaatattgaaatagaaaaaattgtatcaaaaattacaaaaaaagatattgataaaatgataaataaattgcgaaaacaacatcctgattggaaattagttaagagaatatcaaaattatacgacaagatagttattgattttaatggttcattaccaaataaaaaaaaatttcaaggatcatctgggaaaaatgtttcatttattttaggtcaaagcaatacaatagataattttatgaatcagttgtatggtttaaaagaaggtgaaaaaaaaaaaatacatgtttcatttcctaaaaattacaaagataaaattatttcagggaaaactgtaatatttgatatttttgttaaaaaactgtatgaaccagtttacccaatattaaataataatttttccaataaatttaattttccaactttggatatgtttttttctgaaatacaaaaaactatggaaaatcaacttgaaaatttattatttcaaaaaaataaagaaaatttaatactaatattattaaagcattataaaattactgatatacctccaacacttataaaaaatgaaatagattttattaaaaatacaaaatttaaggataaaatatctgaagatataattgaatctaaagcaaaagaacgagccatattaaatattttatttactaaagcagtagaatttttcaaaattacagtttcagaaaaccaaatccaattatatatcgataaaatttcacaaatttatgaaaaccctaagggtttgaaagaaagttatttaaaaaatatagaaaaaatacaagaaattaaacaaaatattcaagaaaaaatggtagtagaagcattgtttaattcaatgaattcaaaatttaaaaatgttaatttttatgatttaatggaaaataattaaaaatattgcaaaatataattattgtagaatagtaaggaaaaattttaattatgaaaaatataaatagtttagttcctatagtaatagaaaaaacaggttatggagaacgttcttttgatatctattcaagattacttaaagaaagaattatttttttaataggaacaataaatgattgtatggcaaacttaattgttgcacaatttttgtttttagaatcagaaaatcctaataaagatataagtttatatattaattctccaggaggattggttacagctggtatgtcaatatatgatactatgcaattcattcaaccagatgtaaaaactatatgtataggacaagcatcaagcatggctgctttaatacttactggaggttctaaaggaaaacgttattgtttaccacatgtatcgttaatgatacatcaacctattggcggatatcaaggacaagcttctgatattaaaatacatgctaaacaaactttaaaagtaaaagatatgttaaataaaataattgcaaaacatacaaaaaaagatatttttcaaattgaaaaagatactgatagagataattttttagatgcacaagatgcaaaaaaatacggattaatagataaaattttaaacgaaagaacaataaaaaaaaaataaatgttataattttttttaaaaattagattttttttttacagtttttagaaattaaggatatttcatgaataacaaaaatcatgacaaaattaaaaatgatgatacacattgttctttttgtaaaaagaatcgatttgaagttaaggatttaataaaaggggcgtctgcatttatatgtactgaatgtatttatgcatgtttaaaaataatacaatcaaaaaaaattaatacaaataaaaaaaataatgattttttatatcaaaaacctatagatattaaaaattatttggataaatatgttattggacaagattatgcaaaaaaagcactctctgtggcggtatataatcattataaaaaaatatcaaatatgtttgaagatatagaaatagataagagcaatatgttgttaattggacctagtggatgtggtaaaacattccttgttaaaagtttagctcgtatacttaaagtgccgtttgcaatagcagatgccacaactttaacagaatctggatatgtaggagaagatgttgaaagtattttacaaaaattattacataatgcagattacgatttagattatgcaaaaaaaggtattatttatattgatgagattgataaaatttcaagaaaatcagaaaatacttctattactcgtgatgtttctggagaaggtgttcagcaagctttacttaaattaatcgaaggaacaattgcttcggttcctagtaagggtggcagaaaaaatcctcaacaagaatttgaaaaaattgatacttctagtatattatttatttgtggtggttctttttcagggattgaaaatataataaaggaaagaacagaaaaatccaatataggatttaatgagaatattttattagatgataataaaaataatagcaagttaataaagaaagtagaacctaatgatctaataaaatttggtcttattccagaatttgttggaagattacctattataataatttttgatgatttagatgaaaatgatcttattcaaatccttacaacgcccaaaaatgctcttttaaagcaatataaatatctttttaaaacagaaaaaatagaaattgattttaaaaaagatgcaattaatatgattgcaaaaaaagcaataaattgcaaaataggagcaagaggattgcgttctatactagaggatatattgttagaaacaatgtatactgttccatcatatcctaaaattagaaaaattattattgataaagatgttattcaattagggaaaaaacctcaattaatataaaagatagaatattttttatgattaaataaaattaatgaaaggtaatttttaaaaatggaagaattaaaaaaatgtgatattatcacaaaaaataaaactattaaaaaacaacttcctgtcttgccattaaaagatgttgttatttatccatatatggtaattccattatttgtaggacgtaacaattcaattaatgctttagaggttgctatgaaaaaagatcaaaagatttttttagtagcacaaaaaaaatctgaagatgaatctccaaatattaatgatctattttgtattggtactatttcatctattttacaattgttacgtcttccagatggaactttaaaagttttgatagaaggagaaaaacgtgcaaaattgattcatattttagaacatgataatgcaaaagaatatttattttgtgaagttgaagaaattaatgattttatatgtaaaaatattcaattagaagcacttagtagatttttaatttctcaatttgatcaatatatgaaattaaataagaaaatttctccagaaattttctctgtattatctggaattgaaaatcccagtcggctttctgatactattgcagcacatatgtcaataaaacttcaagatagacaaatgttattagaagaagaagatttagaaaaaagaatgaattccttattaattttattagaacatgaaatagatattcttcaaattgaaaaattaatccgtaaaagaatcaaaaaacaaacagaaaaaaatcaaaaagaatactatttaaatgaacaaatgaaggcaattcagaaagaactttcgcaatcagattctgaatatgatgaaataaaaaatttagaaaaaagaattaaaaaatccaaaatgtcttctgatgcttatgaaaaagttttaaaagaattaaaaaaattaaaaacaatgtcattgatatctgcagaagcaactgtaagcagaaattatattgatactttattagaagttccatggaaacaaaaatctaaaattaaacataacttaattcgtgcaaaaaatattcttaataaagatcattatggattagttgaagtaaaagaaagaatacttgaatatttgtcagtggaaaaacgtgtacgaaaattaaaagggccaatactttgttttgtaggccctcctggagtaggaaaaacttcattaggttcctctattgcatctgcgacaggaagaaaatatacaagaatttcattaggaggtgttagggatgaagcagaaatacgtggacatcgtagaacatatattggtgcattaccaggaaaaataatacaaaaaatatctaaatcaaaagtaaaaaatccattatttttgttagatgaaattgataaaatgtctactgattttcgtggcgatcccagttctgctatactagaggttctggatccagaacaaaatatatcttttaatgatcattatttagaagtagattacgatttatctgaagtaatgtttattgcaacagcaaatactatgaatattccattgccattactggatcgtatggaaattatacgtatttccggatacactgaagatgaaaaaattaatattgcaaaaaaatatttaatacctaaaaatattaaagcttgtggtataaaaaataatgaactttatttagaagaaaaagttattttatcaattattcgatattatacacgtgaatcaggagttagaaatttagaaagagaaattgcaaagatttgcagaaaagtagtaaaaaaaatattagaatcatcaaaaataaaatctattactatttctaatacaaatttacaaaaatatttaggagttagacattatcgatatggtattaaatctgcaaaaaatcaaatcggtcaagtgacaggtttagcatggacagaatttggaggcgaattgttacaaatagaagcgtttgctatgcctggaaaaggaaaaatattacgtacaggaaaattgggaaaagtaatgcaagaatctatacaagcagctgttactgtggttagaggtttgccagaatattataaaattccttctgatttttatgaaaatattgatttacatttacatgttcctgaaggaggaatacccaaagatggtcctagcgcaggaattgctatgtgtactgctatagtttctgtcttgacaaagatacctgtaaaatcagatattgctatgacaggtgaaattacattaagaggggaattattgcctattggggggttaaaagaaaaattattagctgcacatcgtggtggcattaaaagtgttttaatacctaaagaaaatagccgagatttgcaagaaataccagataatattaaagtagatttagatattattcctatttcatggattaatcaagttttagataaagctttagtttcatatgtataaaaataaaataaacaaaatattataataaatacatatgatgtatattatttttttaaacttgatatttaaaattattggcttttattaagtttatattacatattttaaatgaaaaaacaatgatttagagaaatttttagtgatattacaaaaaatacgaaaaaaaatttctaattggtttatttggatttttattattatatctataataattttttcagcatttggtataaattatttttttaataaaaaaatttatgacaaagattatatagctattgttaataatgaatttatttctcgtatagaatttttaaaaatatatgaaaattataaaaatcaatttttaaataaaaaaaataataaaaaaaatattttagaaattaaaaataaaattttaaaaaaattaattattaataaattattaattcaacatattaaaaatataggtatgactttatctaatcaatatattgattcaatcatatcaaatttccctatttttcaaaaagacaaaaaattttcattaaaaaaataccataaatatttagaatatactggattaaatactaatataattcgtaagaatttattaaattttttaattaaaaatcaattttatttaggaattaaaattagtaattttgctatgccaaatgaaattaaacgacaagctattttagaatcgcaaataagaaattttcgatatataaaaatttctgatgctaaatttaataaatttaatagtatttctgataatgagaaaaaaaaatattataattcccataaggaacttttttttgaaaaaccaaaaattaaaattgcatatcttattgtttttatggaggatattataaatagtgttaatattaaagaaaatgaaattcaagatttttataaaaaaaattcgaaaaaatattttaaggattttaatattgaaaaaataaaaattaaaaaatatttaaaatataaaaagtctaaatatatttttaatcatattaaattgcaattaaatgatttaagtcaaaaaaatccacattctttatcatatattgcatctatattacatttaaaaattataaatactggatggattagcaagaataataaatataatactggaatatttaaaaatcctaaattaatagatatatcctttagcgatcgtgttttcaaaaaaggttataatagtaaagtaatttatattcctaatttaaaagctatattggtattaagaataatagattataatataaaaaaaataaaaaaatttaatgcagtaaaaaattttatagagcagaaaataaaaaaagaaaaatctatttataaagttaataatatagctataaatttagtaaaaaatttaaacaataataaaaatatatattttttaatgaaaaaatttcatttaaaatggatttatgaaaataacatttcattgcattctaataaaatgaattttttaacaaaaaaagctttttctcaaatttttttaaaaaaatgctttccatataaagcaataatatttagaaataatcattatttttatatactgcaagtaacaaaaatccattttaatgaaaaacctaaaatttctttaaaatatcaagaaattcttcgcaagaaaattttaaatatttggtttgaatatgaatataataaatatatttctaatttatataaaaatgctagtattaaatataatttataattatttacttaatataaataagttgtatttcgctttgttaaataattttaaatttattaattgtaaaatattatgataaaaataaaaattagaaatttttttcaaaaaagaattaataacgctattcatccattaacaaaaaagttattccaattaatggaaataaaaaaaaccaacttagctttagcaattgatgttacaaattcatctgaattattatatattgctgataaaataggaccagaaatatgtttattaaaaactcatgttgatattttaaaagatttttctacagaagtaactaaaaaactttctattttatctgcaaaacataaatttttaatatttgaagatcgaaaattttctgatattggaaatactatacaaatgcaatataaagaaggaatatataaaattttttattgggcagatattgtaaattcctttggtttttcagcacaaggaataatagatatcctaaaaaaagaaaaatcttttcaaaaaaaaagaggaattttattaatatcagaaatgagcaataaaaattattttttctcaaaaaaaaataggattttttgctacaaattggcaaaaaaataccccgattttataatgggatttatttgtcaagaaggttttaaagatattagatttatttatttaactccaggcatacgatttcaacatgataaggatgattttgatcaaaaataccgtcctcctgaagaggctttaataaaacaaaattgtgatatcctaattataggaagaggcattcttcaatccaaaaatcttatacaagaaaccaaaaaatataaaataaaatgttgggatatataccttagaaaaatattagcataatagttgcatgctataatttaagtttgtaatataaaaaatattactctcataacaatctagaatattgtttataacatggaaaattataaggtatgttaatattaactagaaaaataggagaaactatagtaataggagataatattactgtaactgttcttaatataaaaggaaatcaaattagaattggaatcaacgctcctcaagatattcaaattcatcgtaatgaaatttatcaaaaaattaaaaataattaataattaatttaatatttatggcggagagagagggattcgaacccccggggcttgtgtaacccaacggttttcaagaccgccgcttttgaccactcagccatctctccattataaaatttgaatttgtaataatatatattatttaaactactaataatagcagatgcttttaaaaaaatatattaaaattataaacactttttttataaagaaaataatttaaactgactaagttttattgcatatccaatatagtttgatggagttgttttatataatatatttttttgtgattgcgataaatttaatgatttaataaatttatatagatcttttttgctaattttttttttcccatcagtgaattccttaactttctcataaggggttttgcatttataacgtcgcattatagtttgtattgcttcagaaagaacaatccaattttcatttaaatcttttgatattattgtgagatctgcttcaatcatatttaatcctttttgtaaagattttatgccaattactatataagataaagcagttccgatatttcttaatacagtagaatctgttaaatctctttgccatctggatataggtaatttcattgccatatgatttaataatgcattacttagtcctaagtttccttctgcattttctaaatgaattggattaattttatgtggcatagtagaagatcctacttcttctttttttatattttgcttaaaatatcctagtgctatataaccccaaatatctcgacatagatcaattaaaattatatttatccgtatcaaattatgaaaatattctgcaatataatcatgtggttcaatttgtgttgtatgaggattccaatttaattttaatatttttgtcacaaaatttttggaaaattttatccaatcaatttctggaaaagatataacatgtgcattaaaatttcctactgctccattaaattttccaaatatttgaatatttgataacaaatttaattgtcttactaaacgttgttcaaaattacgaaattctttccctaatgttgtaggagatgcagattgtccatgtgttcttgatagcataggtaattttgcatacatatacgacatcatatcaagtttttctgcaattattttaaattcttttaataaaattttatctcgacaatctaataattgtaaagcataagataaattattaatatcttcagaagtacaagcaaaatgcacaaattctacataatttttcatatcttgacgttctgctaatttatttttaataaaatattcgacagattttatatcatgttgtgtaaatttttcgattttttttatagtataaaagtctttttttgaaaaattttttacaattctatttaaaaaattttcttgatctttagaaagtaaagggcattcctttactaaaggtaaactagaaaattcttttaataaaagaatttctatttttactcgataataaaaaagtccatattcagatgtaaaaatatttaattttttgcatttagatttatatcttccatctataggagtaatattgagaaaagtttcaaaaaaatccatattctataaataaaaaaaaataatattatatcttactattaaaaaaaaaaatatatatataaattataaatgtttaaacattgaactaatagattcttcactattaattcttctaatagtttctgataaaattttagataaatttaattgtatgattttagatgaaacaatagatgaagaagataacataatagaattggttgtaacaatttcatcgatcatagatttttctatattatttaatgcatcttttgataatactggatgagtacagtaagctgatactctttttgcacctttttgaattagtgcttcggcagctttgcatatcgttccggcagtatctgctatatcatcaataataatacaatgtctgtttttaacagaacctattatattcataacttgagaagtatttgcatgtattctacgtttatcaataatagctaaatcacaatctaaattttttgcaaatattcttgctcttataacaccgccaatatctggagagactattattacattttctagttttttctttttaatatgagatattaatataggtgatgcataaatattgtctaatggaatgttaaaaaatccttgaatttgttcagcatgtatatcaactgtaaccaattgattaacacctgatgcagaaattatatctgctactattctagaagtaattggacctcgagaagaaggaagacgtcgatcttgtcgtgcatatccaaaatatggtattacagcagtaatacggttagctgaagcgcgatgtaaagcatcagacatgataatcaattccattaaattatcattagtaggaggactagtagattggattataaaaacatctttcccccgaacattttcttggatttcaacatatatttctccatcgctaaatttgccaacataggctttacctaatggtaaagataaattttttgctatatcttttgcaagatatggaactgaattaccagaaaaaattattaaatcattcatgaatattgcctattcaaattaaaaaatatttggctgggccgccaggattcgaacctgggaatgcggggatcaaaaccccgtgccttacctcttggcgacggcccatatttaaaataaagaattttatgaataaaataataaaatttcaagaaaactttacatataaaaaaatttttaatatttttattattatttaaattttttatatcaaaattttatataatattaaatataaaaatactaaatatattctataaaattttattattttttattaatttaaattaatttaagttgaagtaattatttgtttgtatttcattaattacattaattaaagttttcccttccaatttttgtattttaatttttaaagattcaggagtctcatttttcaaaatagaacatgatgcttgttttaaaacatatcctgtatctacatttttttctacaaaatgaacagtgcatccagtttttttttcttttgctttaagaactgctttatgtacttgaagatccattaaaccagaatatttaggcaataaagaaggatgtacattaataatacgatttttccacttttttataaaccaatgggatacaattctcatataacctatcattacaattaaatctaatttatgtttttgcaattccaaatgtatttttttatcaaaatctttacgcatttccttatttttagataaaatgtattttttttttatttgaaattttgttgctttttttaaaattcctgcattaatacaatcactaattattataactattttagcatttaattttttatttttaatagcatttacaataggaattaaagtatttccatttccagatcctaaaattgctaaatttaacatatttaatactaaataattgatgtttttatatgatgttggaattttccaatatcttttctataaaaaacaggaccaaaaattttagaagccatgtattctgcttcttgttccgcttgcattatatttatattttttccaagaactccaattgctcgtgaagaagtcgtaattattttactatttttttgatttactcctccgaaaaataatgaattatcattgtttatatatgataaatctataataccattttggacagaattatttggatacccattaggtactatatattttactaccgttgctatatttaaaaattttatgtttaacttgtgaagtgatgtattaataatggcatagcaaatatctaaaaaatctgtattcaaaatagataataaattgattgcttctggatctccaaaacgtgcattgaattcaattaattgaattctgtttttagattttataaaccccccatacaaaatgcctttatatttacaattacagtttttttgcaaagctaaaattgttaattcatttattttttttgctaaattaatatcttcagaagataagaaatataatttatgattactatcattataacttcccattcctccagtattaggtccaagattatttgtataagcacgtttataatcttgtacgattggcatatgttgtaaagtattcccatcggaaaaagaaagtaaagaaaattctaaaccatttattttttcttctataacaaaaggaccatttatgttggagcaaaattttaaagcttcttcatgagaaaataaatctttatttgccactttaactccttttcctccttctaatccatcagattttattacatattcttctgaaagctctaaaagaaatttttttgtttctaaatttactttatcaaatctcttatattttataagaccaggtatattatttttctttaaaagatctctagcaaaacctttactgctttcaattcttgcaagttctttaacaggacctataattttaataccagctttattgaaagaatttgctatgcctaaagaaagtggtaattcaggacctactatagcaaaatcaacattaaaaaatattccaaaatcagttatatatttaatatctttaatatttccaattaaatatcctatgcataaagaaaaaatccctggattaagatttgtagcaaaacaatataaaagagattttgaagaatataatgattttgctatcgcatgttctctagcaccagatccaataattaatattttttttttttttataaacatttttattaatattattttttatttaaatattattaatttataaattttatactaatttattggaaatttataatcttattttttataatatttataaataatatttatatcttaaattttttttataaattaatattatatgaataaaaattctttaaaaattaaaagcgctattatttctgtttataataaacatggtataaaaaaattagctcaggaattaaataaacgaggagtagttatttattctacttctggtactaaaaattatttaaaaaaagcatctattaaaacattttcaataaaaaaactgacaaattttccagaaattatggaaggaaaaataaaaacattacatccaaaagttcatggtggaattcttggggaaagaaataatgacataaaagatatatctcatcataatatacattggattgatttaattgtatgtaatctttatccattttttgaaataattcaaaaagaaaataatatagataaaataattaaaaatattgatataggtggatcggccatgatccgttctgctgcaaaaaattttgaatgggtttcggttttaattgatccaaaagattataatttaattatttcaaaattggacagcggagtagattttatacaaagaaaaaatttttctattaaagcattttcttatacatcaaaatatgattttactattttcagatatctttcaaaaaaagaaaatataaataaaaatacatatttttctaaaaaatttatatttaaatcaaataaaatatatgatttacgatatggggaaaatcctcatcaaaaagcaagtttgtatagtaatagcaattcttgtaaagaattatttataaaaaataaaattcaaggaaaaccattatcttataataatattgtagatagttctgtagcaattaaatgtctttatgaattcaaagaagcagcatgtgttattgttaaacatggaagtccttgtggagtatcaatatcagataatattgatacggcttttcaacaagcatgggagggtgataatatttcagcttttggtggaatagttgctttaaataaaccttgtacactaaaaatagcaaaatttttaattcataattttattgaaattcttttagcaccaagatttaaaaaatcaatattattaattttgtctaaaaagccaaattttcaaattattgatttagcaaattaccaatataaaaaagattctttttttttacaacaagtattggatggttttttattacaagaaacaaatcaatataatattattaatgatgatctatttgttcctacaatattaaaaccaaataaatctcaattaaaagatatatttttttcttggaaagtaattaaatatataaaatcaaatgcaattctaattgtagaaaatagaaaaactttaggaataggcatgggtcaaatgtctagaatagatgcagtaaaatttgctattttaaaagcaaaaaataaaatatctatatcatctattttaatttcagatgcttttttcccatttcctgacgctattaaattaatttcaaatgcaggaattaaaattattgttcagccaggaggttctataaaagataaaattaatattaatatttgtaataaatatggattaataatgctatttacaggcaaacgttgttttactcattaaaaatgatatatttttttgcaaaataattataggatatattattaataaaaatgtacatcccttattaaaggaggaattattatttcaaaagttgctattgttatgggttcaaaatcagattggccaattatgaaattttctgcaaaaatactttttaaattacatattaattattatgcaacaattgtttctgcacatcgcactcctgatcgattgtttcaatttgcagaatctttagaagaaaaaggatatgaggttattatagctggtgcagggggcgcagcacatttaccagggatgcttgcttctaaaactcatttgcctgtattaggtgttcctattaagaataccgatttacaaggattagattcattattttcaattttacaaatgccaaaaggtattccagtaggaactttagcaattggtaaagcaggagcaataaatgctggattatttgctgcttctattttatcattaaaagataaaaaaattcgaaatttattaataaactttcgtaaagaacaaacagaaaatatccttaaaaatacagaaattatttaaaatatgataacaataggtattattggttcaggacaattagcacaaatgataacacatgttgcttatacattaagcataaaaactttatgttatagtcaaaataaaaattgtccggcttctatttttagtcctatttttgtaggcgatttttttgatttacatgcaataaaatcttttgtaaaaaaagtagacatagtaacaatagaaaatgaaaatattcctaaattttttttattaaatatttctaaatatataaaaatttttcctaataaaaaatctatttttatttctcagaatcgattattagaaaaacaattatttaaaaaattaaatattcttacaacaaaatttataaaaatttataattttttggatctacaaaaatctatcgatacatttccattgcctgctatgttaaaaacacaatattttggttatgatggaaaaggacaatattttatttctcataaaaaccaaatatttaatgcttggaaatcgctacaaaaaaaaccatgcatattagagaatatcattcctttttctgaagaaacttctatcattgctgctagaaattctttaggtaatattcaattctatcctttaataaaaaataaacatatctctggtattttatatatatcaactttagattctaatacagaacatccgttacaaaaaaaagcagaaaaaataattaaaaatttaatggaatatttagattatattggaataatggtgttagaattttttgtttttaaaaacgaattaattgctaatgaaattgctccacgtgtacataattcaggacatataactttgaatgcatgcaatataaatcaatttgaacaacatttacgttctatattagatatgcctttattaaaaccattggtattatatgattctgcaatgattaatattttaggaaaaaatataaatataaaagcaaaaaatatctttcctgaaatccatgtatataaatatagaaaggaagagttttctagaagaaaattaggacatattaatattacagcatcttctacagaaaaaagagaaaaaatcattaatcaaattttgaaaaaatttcctccaattttatagaattatttttaatccatttatataaatatttattaattacttttctatctaaatttacaacatctatggatttacctattaaaaccaaaattgttccaggaaattttatccatttatttttaggccaaaatttacctgaatttaatacaataggtattattttagatttggtcttttgggctaaaacaatgcctgttgtataaaattttgggtgctcatttggaagcgttcttgttccttcaggaaaaataataatagataaaccttctaattttcttttttctcctaattttaaaattttttttatggaataaattccaagttttctgtcaatagctatatgtcgtccaagacgcattccccatccaaaaaaaggaatatttaaaagagatttttttaatataaaacaactattaggtaataagcttaaaaaagcaaatgtttcccatgcagattgatgtttactaaaaaaaataatagatttatttttaggtatattttctagtcctttaattttatatttaattccacaaaatattttaattgatattaaaatcaaacgtgaccatatataaaaaagatattttcgtactttaaaagtaaatgcgagagataaatataataataaacaccaaaaaatagataaaattgtaataaaaaataaaaataaagttgatcgaataaaaagaaaaaatatcatcttttatttccaaattaaccaatataaagataaaaaataatttttcaattaaaaaattatcgatttaaataatatattatttataatttattttatttatataatattatattatatataatatttaaaataattaaatataattaataaaatattaaaaattattttccagatattccaattaaaaaagattttataaaaaaatatcaagaatataccaaattagtttcttctagtaatttttcttatggaattgaaacttattttgcatttaagattaactatgtctgcagaaaatagtatttatcaaaaaataccacaagcggtaattttcccaaaaaataatttagatatacaaatattattttcaatacttaaatattcctatttatttttcattaaatacaataattttgaaaatactattgtatgaggctataaaattaataaaattttctcctatttctatttaaaaaattgatgaaaatatatatgttatagcaaaaaaagatgaaatttatcaagatattaaaaaatatttttcatcaaatgataaaagaaaattaaagcaattaattttatagaaattaacggcaaaaattttttttttacaaaaaaaatagaaatagaaaaatatataatttattcaataaaaaaaatacaatagaatatttttttgtatctaataaaaaaaaataaaaattttatggaatttttgtaaaaaaaagtgttagattactatctaatataaaagggaaaaacagactatacctcttgtagaggatacagattttcttccaaaaaatctttttttatatattatagaattttttcttattttggatcatttaaattaaaatatggaatatttgatcatgttgatgcagaatgttttcgtgtttaattagcattaaatatgcaataagaaaaagatcgtaatttagcaattattatttactaattaaaattaataatttagtaaaaaaatataatggtatcttttgatctgattatgaaaaagaattccgaataaattttattaaagattattttggagaaattttatttcaaagtttatgtaaaaataaaataagttttgatccttataatcaattaaattctaataaaatagttatctcatataaaaaaaaatgatttctataaatagacctatgaaaggagaaagaaatcaacagattaaagaatattagaaaaatattttttataatcttatcaaatacaatgaaaatgcacaatgtttagattgttatatagatcgtgttattttcccatcaaaaaagttacaaataataaattatatcttccaaaaggaagagtaattattaaaagaagagcatttattattagagaacggttaagtagtatttctattagttttaaatatactacaaatattacatttttaaatattattaatagattgaaaaaataaaataataaaatctaacgttacatacaatgatttttcttatcaagtatgcaaagcaatggaaaattttctaggttttaaattttgtacatcatcatgttctatatatatagatataccatcgataatcaaaattcttattttatttagtcattattctaaatgttctttgtcaaaaatataaacagtatattggaaaaaaatatttttttattttggaataaaaatttaaaaagttttacaaactggtttttgtagaatgacagatagttttggacatgaaatagaacatgttataaattctaaaaatttttttgaaattatttggtaaaaaaataaaggaaaattctaatttaccattagttatcgaatattcatgtagatttcaaatgaaaagatgcacaggtatttttgcaaaaaatccaattgaaattttaaattctattttagaataaaataaaaattattaagaattaagattgtttaaaaaaaaaatttttattatttattagaaatacaagtggtaattttttgtatttttttagtttttgaatacatgatgatactatcaatgatagatgtttgtgtgttttttttaattcctttcaacataaaactatcagtaactccagtagctaaaaatattaaatctttagatacaatttcttgaagattatattttctatttaaattttgaatatttaatttttttgccttatttttttcatcactattttgaaataaaagtctaccttgcatgaaaccacctatacaacgtatagcagctgcagttaatacaccttctggcgctcctccaataccaacatacatatcaataccagtattaaaatatttagatgttgaaattcctcctaaaatatctccttcatcaataagagaaattttagatcctaatgttttaatggattcaataataggataatgtctaggtctatttaaaatacaaacagttaaagatttaacagaagttttttttgcttttgctaaattttgcaaatttatgacaatagattcatctaaatctacaattcttggattatctaatccaattactattttttgcatataagtatctggagctttgagcaatcctcctttttcagaaatcgctaaaacacttaatgcattaggttttccatttgctaataaagaagttccttctaggggatctaatgcaatatcatatttaccacccttctgattaccaactttttcaccgacatataacatgggagcattatcacgttctccttctccaataacaattgttccacaaattccgatatttttaaaagattttcttatagcatctactgcttctttatctgctttttgttcattgcataaaccaaattccttaaaagaagctattgcagccgattcggtaacatttaaaatttctaatgaaatattttcaagcattttattaaaaatactatgtaataataaatacatactattatagatatttttttctaaatttcaatctagaataaaatttagaaaaaaaaatatataattaataaaatatgaaaaatataaaaagttattttagaaaaagaggaaggattacaaatttacaaaaaaaatctctagaaaaattttggcatacatatggaatttcagtagaagatagaaaaattaaacatggcaaaatttttacaaataattttcctattttttgcgaaattgggtttggaatgggagatagtttattaaatcaagcaatacaatttcctaatgttaattttataggaattgatatttatcaacctggaataggttcgctattacataatattaaaaaatacaatcttaccaatattcgaatatattgtcatgatgctgtagaagtttttgaaaaatgcattcctgataatttaatacaaaaattgcaattattttttcctgatccttggcctaaaaaaaaacatacaaaacgtagaattattcaaaaagattttataaatttaattactaaaaaagtttcttattctggatatttgcatatagctactgattctaaagaatatatgaaacatattttaaaaataattaaatatccatggatttatcaagaaaatattcaaaatatacctgttctttacactttacgatttccttcaaaatttgaaaaacgaggaaaaaaaatgcataataaaatatatgatataatatttatactttcagatattgtataatttaaaatttatttttatattttttgtatattgaatatataaatgaaattataattatagattattaaatatatcaattaagattatgaagataattattttaggctctggacaagttggcacatctttagcgaaaaatctatgtttagaacatcatgtaactattattgataaaaatcctaaacaattatttagattacaaaatcaatatgaaatacatggagttataggaatggcttcgcatccagatattttgaaaaaatctggtgctgaaactgctgatatgattattgcagttaccagtagtgatgaagtaaatattatagcttgtcaaattgctcatatattattcaatattcccactaaaatcgcccgtgttcgatctcgtgaattattaaaatatcctcaaattttttattcaaaaaataaatttattaatactatcattaatcctgagcaactagttattcaaagaattatacgtcaaattgaacatccaggaacaataaatatattagattttgccaaaggaaatttaaaattagcatctattcgagtaactcctttttgcaaattaattggatccagaattaaagaattataccaatctctttataagagagatatagctataattgctttaattcgtaataaaaatgtttttttagcagaagataatttattgattgaagtacatgatgaattatatttttttactagaacaaaagatattaataatattacacagatattacttaacaaagaacaagaatatcatagaattattatagcaggagctggaaatattggatctggattggcaaaggaacttgaaataaattataatgttaaagttctagatcacaataaatctcattgtgaaaatgctgcacgattattaaatagagctgttgtattaaatggagatgtttctgatattgatttattatttaatgaaaatattgatgaaactgatttattttgttcagtaacaaatgatgacgagactaatatcatgtcagcaattatagcaaaacgtttaggtgtgaaccacagtattgctttagttaacagttcaacatatgttcattatttaatagaaagaagtcctgatattgatttagcaatatcaccacaacaaatcactaaaggaaaaatattaacttttttacgaaaaggagatatggtaaatgtttatccattgccaagatgcactgccgaagcaattgaattaattatccatgctgataaaaatcattctaatattgttggatgtgctatagaaaatataaaatttccatttactaccatagtaatgggcattcttagaagagaaaatgttatttttttaccaacaaaaaatactataattcaagaaaatgatcatttatttttatttgttggtaataaaagcaatattgcagaaatagaaaacttgttttaaagtaacattaacaaagatatataatattaattatgattaaaattcaaatgtttagtaaaattttaggtatttttcttcttttctttagtattagtatgattataccaataactatttctatatattatcaagaaaaaaatgtttttatttttataaaatcctttttttttatttttttttctggtctatttttatatatgataggtttttatacaaaacaagaattaaaaaattgtgatggatttttagttgtttttttgatttggatttttttaggaatatcaggatcattgccatttttatttttaaaaaattcaaattttgatttcagtaaatcattatttgaatcaatatcaggtttaactactactggttctaccataattacaaattttaaaaatttaccaaagagtttgttatattatcgacaacaattacaattttttgggggaataggaattgttgttttggctattgccattatacctataatggaagacgaaattaatctttacaaaatagaaaatactgatcctatgaaaaataaccaattttatttaaaattttatgaaaaagcaaaagaattatggaaaatttatttattgttaaattttttttgtattattgcatattgggctatatgtaaaatgaatttttttgatgcagtaagttttgctttttctactatatcaacaggaggattttctccttatgatcaaggcatcaatcattatacaagttttacaacacatattatttctattatttttatgttattaggttctattaatttttctttacattatttttttttaaaaaaaaaacgttaaaagtttattgggaaaattatgaatttcgttattttataattttgtgttttataatttctattgctataattttaatattaagaataaataaaatttatcattttccaaaaattttagtatatagtttttatcaagtaatttcagtttttacaactacaggtttttcttcctctaaggattttataaattggcctatatatttaataatattattaatttttattggaatcattggaggatgttcaggatctacctctggtggtataaaatttattcgaattattttatatacaaaacaaatttttcaagaaattaaatatttaattcatccatatggtacttttcctataaaattagatcaagatattatatcaaaaaaaataatatctagtgcatggtcttttttagctatttatatatttgtatttttaataatgtggatactattaatatcttttggattagattttaaaagtgcttttttttctattgctacatgtatttctaatacaggaattaatttaggtataaatttttcaaaaataggtaatttatcccaatatttattatcatttgctatgattatgggtcgtttagaatttttttctatattaattttattttcaccaattttttggcgtcgctaaaaaatttatattatatattaatataataattaaattatccctccttatgtaaaagaatatatattttttattcaataaatttttgatctttttttaacaaaaaagaaatgaaaaaagctaatcctacacttataggaattacagatatggctattttataatcatgcaaagaataaaaaggtattttattaactattttcccagaccaactccaatcaagaatctctcctaaccctctttgaaaaaacattccgcctaacattgttatagcattaacaaatgcaatagaagtaccgactgaatgatatggagaaatatccttggcaataacaaaactaagtatttgtacagatgaaaaagctccaaataaaaagaacattaaacatacaataatataaggcatagattgtatatataaaattggtaaaacaatccaaaaagcaacaaaagatccaatttgtaataaaattacacgtttatctaaataatctgataaaattccaatcattaaagatcctaatgaccatcctaaaaatatcattgataccgctatagaagatttatgaacactataaaaatgtagtttttctaaatatggaattccccacaatgcagcaaaaacagatgttggtagaaacattaatcctgcataaattcctgtaaaccaaagtctttttattttacaaatcaaccaaaattttttcaaactttcttgaaaggattcactattaggtgttatagaaaaatttttgttgtaagaagatttgatactaataaaaaaagctaaaattagcaaaaatcctaatgcagtaaaaatatgaagtgtatgtctccatcctattttttctaccatattttccataaaaaccgtgccaatagaagcacctaaaaaacctaacatggttactataccagtaaaattagcaaatttatcatatcttaaatatatagatgcaagtttcaaggaacctacaaatgcaaaagcagatcctattccttgtaagaaacgtccgaaagaagctaataaataaatatgtgtatttccaattaaaaacgttcctaacgtacaacaaaatatagatattatcatgataattctaatatcatatttatctacaattaatcctacaaaaaattgcattggagtataggaataaaaataaaatgcacttaatgtcccaaaaagtgttgcattaatcaaaaaactttgcattaattgatgttgcataacactaggggatattcttaaaaaatattcatagcaataaaataaagcaccaagaaaaaaaataaaaaaacctatattagtgttttttttcataaaattataacttatattaaatataagtaattattttatatctaaatggcaaaaaagtcaatttggcggaccggacggggatcgaacccgcgacctccggcgtgacaggccagcattctaaccatctgaactaccggtcctaattttaaattgatttggtgctggcaccaggatttgaacccgggacctacggattacaaatccgttgctctaccaactgagctataccagcaaaatacaaattatatgactattaaaaaataaaggcaaactttaatatgattaaataatcattataattgtaaaaaatattgaaaatattttatggttagtaacaatttatatatctaaaaattagaaaataaaattatgatatctaagataaaatatatagcattttatatgttatactatagaaattctataattaatattataaataaaaatcacatttcttctttattagagataaataaacattttttacatattcacaatattaaaatactttgtctagattttgatggtgtattaggcttttataaaagcaatacaattcttcctaagataaaaatttggcttaaatatattacaagtattttttctgaatcttgtatatatattatttctaataatcattatcataaaagagaaaaatattttattgatagatttccagggattcattttataaaagggtttccttcaaaaccttatcctcattctttatataaaattgtatctatatctaatattaaacctaaaaatatattaatggttgatgatagattattaacaggaattcttgcatcttgcattgttggtacaaaatcattatatattacattgccttatgcaaagaaatcatttttagaattttattttcattttttacgttttatggaacgtttattttttatataactaattttagtttataatttaaaaaattaattaaattttagagtaaagatatttataatgaagtataatctaaaaatttataaataaatataaatcatataaatttaaactatgttgatcactcgattttcaccaagtccaacaggttctttgcattttggaagtattagaactgcattgttttcttggttgtatgctaaacaaaaaaaaggaaaatttattttacgaattgaagatacagatttacaaagatcaaataattatttttctaatctaattttagatgttatgaattggttaaaaatatcttatgatgcaggacctttttttcaacaatctcgaaaaaaatattatcaaatgtatatacaaaaattattaaaaagcggatatgcatataaatgttattgtagtaaagaaagattagcaaaattaagagaaatgcaaattttaaaaaaacaaaatcctaaatatgatggatattgtagaaataaaaacattaaaaattctaatttttatataattcgatttaaaaatccaaaaaatggtcgtgttatatggtatgatttaattaaaggtaaaatagaaatatctaattcagagcttgatgatttaattctttctcgttctgatggttcttatacttataattttgcagcagctgttgatgatcatcttatgaagattactcatgtaatacgtggtgatgatcatgttagcaatacacctaagcaaattaatattttacaagctatagatgggtttatacctaaatatgcgcatattccaatgattttagataaaaacggaaaacgtttgtctaaaagacataatacaactgatataattgaatatcgaaatttaggatatttaccgcaatcattattgaactatttaatacgactaggttggtctcataaaaataaagaaatattttctataaatgaaatgataaaatattttaaattgcaaaatgttaaccaatctgcgtctatttttgatatcaataaattgagatggttgaatcggtattatataaattccttatcttatgaagatataaaagaagaaataaaaagacattttctcaatgccaatatagatattcataatggtcctaaattaaaaaatgtgtttttattaatgtctaaaggaacaacaactttagttgaattagcaaaaaaaagtaaatttttttatcaagaaaatataaaaattaatattaatcttgaaaagaaatatttttcttatgaaacacataaacatataaaatatttgtatcaaaaattattttctatagaaaaatgggaatctttattaatttttcaggctataaaaaatacaatgaaaaaatttcatttaaatattaaaaatattgctatgcctatgcgaattattattactggttttgataattctccatctatttctcatattgctgaacttttaggaaaatatagatgtttatcaagaatacaaaattttttatccatgaattaaaaattattgattattttaaattaaaaattaatatacaattttttttttaaagcctaaaatcttaaattaaaattagaataattaagcataaaaaatattatgaaaaaaataccaattattgtaggatttggcggaataaattctgctggcagaacttctggatttcattcttataaaagaataatacatagttttttatctaataaagaaatgcaatctacatggttagatttagcaaatcgtatgaaaattaaacaaaaaaaaaattatataaataaaatactaaaaggaacacttatacgaaaaattgatagctttaatccagatgctgttatagattattttaatttagcatattcatcagaaagtttaccaaatattaaatttaaaataagtacatttcgattgccttctcctattccttcaaattggaatttactaaaaattaataaagatattgcgagtattgaaataaaaaatcctaaagagattcttgttccaatctctaaaaaattagaggttacaactgctggaaatattccaaaaggttttaatccaggaagtttatataattctttatatcatcctcgatctctccaattaggtgtatatggaatttctgatgcaattaattcattaggattagattgggaaaatattatgcattatatatctccagataaaatttctgtttatgctggtagtgctttatgccaatctgatgaaaattctttaacgggtttatctattaattccaaaattggaaagcctattaatgctaaaatgattgcattgtcattttctgaaatgacagctgattttattaatagctatataattaatagtgttggtaatacaggatccaatatgggagcttgtgcaacatttttatataatttaagaatgggaattcaagatattcaattaggaaaagcaagagtggttattataggaacttcagaagctcctatatctcctgaaataatcaagggttttagtagaatgggagcgctagcaaaagacaaaaattcaattaaattaaataaaaacatagattattctcaaatttgtcgtccattttcagaaaattttggattcaccatttcagaatctgcacaatttattattataatggatgatgatcttgttatgaaaataggagctaatattttaggttctgttgaaaatgtttttataaatgctgatggcaataaaaaatcaattacttctccaggaattggcaattatattacaatagcaaaaactgtttctctttgtaaaaagatatttggagaaaaagaattaaataatacttatgtccaatctcatggaactggaactccacagaatcgtgttacagaaagtcatatattaaatacaattgcaaaagctttttctataaaaaattggccagttactgcaattaaatcttatataggccattcaattgcttctgctgcaggagatcaaatttctatagcattaggagtatggaaatttaaaattattccaggtattacttctattgactgtatagctaatgatgtacatcatgattatttagatattttaaaaaatcataaatatttagataaacctcctgttgctgcaattatcaattcaaaaggatttggcggaaataatgcatctgcacttttaatttctcctgaaaaaacaatcgaaatgctaaaatataaatatcaaaaaaatatatggaaagaatatcaaaaaaaatatataaaaatcttagataaaattcaagaaatcgataaatcttcttgtgaaggtaaagaaaaaattatttataattttggtaaatcgattttatcggaaaaatttttaaaattaaatacaaatcaaatttattttagcgattctaatttaattattccttattaaaaataataaattttggcgtccccaagggggttcgaacccctgttaccgccgtgaaagagcggagtcctagacctctagacgatggggacaatataaattttataagataaactttataatataaaaattatacttaaaaaaaaatatccttgttctataaataataaattaagtcttttaaaaaaaaaattatgacatatataagaaagtggtcaagatatttattttttaatttataaaatattttatattaatatttaaatttttaaaatatttatattaaaatttcattaaaattaataaatattttgttgtgtaccattatgaaaattataaatatttctggttataaatttttacatatccatgatgtttttttgcaacgtgaaaaaatgtatgaaaagttgggagatataggtttattaggtaaagttatgattagttatgaagggattaatataatgttatctggagataaaaaacaaattaaagaattttatttttttataaaaaaagatttacgatttacaggaatttcttttaaaaaaagttattctgattatattccatttaatgaattaaaaataaaatgtaaaaattgtattgttccttcaaaatttgatatttttcctacaatacaaaataaaaatacaatcactccaaaaatattcaaatggttattagattataaaaaaaatattactattttagatatccgtaataaatatgaaattgataaaggatttttttacaaatcaatacatttaaatattaatcaatttcgcgatatttatactaaattaaaaaattgttcagaaaaaattaaaaatattcctacaattatgtattgcacaggtggaattcgttgtgaaaaagccatcattcttgctaaaaaggctaattttaagaatgtttatcaagttaatggtggcattcttcaatattttaaagacattggacaaaaatatttccaaggaagatgttttgtttttgacaatcgtgaatctataactgcagaagatgtaaaatatccacaataattttttaaaaaaattatatttagcactttattataaataaatataattaaacttgtaataaaaataaaattttaatataaatgttttaacatttaattaaattgatggtatttttaatcagcattttattttttatgataaaatgttaaaatttaattagattatttatgggtttagaaataatgaatatttggattttgcctaattttttaacatttctccgaatttttattattccattttttttacttttttgttatcttccattttattttttacatgatattgcaattgtattatttttattttctgcattaacagattggtttgatggatatacagcaagaaaaatggataaaatatcttcttttggtgcctttttagatcctgttgctgataaattaattgtgactgttgcatttatgatcataatttcaaaatatcatgaagtatggatcgttattcctataataattaacattataagagaaattttaatatcagcattacgagaatggatggctaaaattggaaatagccatatagttaatgtaacttacttaggtaaaattaaaaccacaattcaaatgattgctatcattattttattaaaacagatatctattaatagattaactatttttggaattattttaatatatttatcaacatttattacactttggtctttaataatttatatgaaatctgcatatccatttattcaatctataaaaagtatcaaaaacaagagttgacaatgtatagtagctaattacaatatttaaattataatttagtttaacttgtatttgcggagatagcttagtttggtagagcacaaccttgccaaggttgaggtcgcgagttcgaatctcgttctccgctccaaattttatttggctggatggcagaatggttatgcaacggcctgcaaagccgataatgccggttcaattccgactccagcctccaaaaaataatatatttttatagttattttataaattataaaataataaatgcccgagtggtgaaattggtatacacaagggacttaaaatccctcgttcattttaaagaacatgccggttcaagtccggcctcgggtaccaaaattaagaattattataatattaacattgttatattaattataattagagttaatatagttattaaaaataaatttcgggcccaaaaaatattattttttacaaaaaaacctttgcaaattatcaaaatccaaactattccaatacatattggaattaaaatatatgatatttttttatattctaaaatataaaaaatagttgtaaaaaaaataaatcctaaactagataataatatatatattttagttttttttatattcttaataagatatataattggaatattggcggtatcataatcttttatatataatattcctatagaataggaatgaggaatttgccaaaaaaataatattataaataaaattattgcaattttatctaaagagtttgttgcagcacaataacctacaactggtggaattcctccagaaatactcccaattattattgcatatataaaacaacgtttaagccaaaaactatataatataatatatacaaataatccaaataatgctattattaatgataatatatttgtaaatattagtagaattataaatcctataattcctaaaattattccaaaataaaatgctgtttttaaagaaattaatttttgtgctaaaacacgttttttagtcctttgcatcaattgatcgatatcttgatcaatataattgttaaacacacatccacaagaaataataaaaaacatacctaaaatagtaaagaaataagaaaaataattaaaatctcttccatgggaggccacaataaatcctccagatgttgtaataatattagctattacaatacctggttttgttattgataacagattttttgcaaattgcatgctttttataaatgaaaaaatattttcaatataacatattatagttcatattatgaataatccaaatagatccaaataccaaaataaatataacaaatatggtaaaaataaaaaccaaaaaattccacattcctttttttttaatatttaaatgcaaaaagaaaacactatgaacaaaaaattgtaatatagcaaaaataaataaaaaacatttgtattgaaatggggaataagaatattttttttgcataattaaaaagaatggaattattgttaatataacagataagaaaaatccaaataaatatgatttaaaagtatattctgattcaatcaatggttgtttttttttctttatcattcaatatatcctaataaataaacaatagtaaaaataaaaatccaaataatatctagaaaatgccaaaataaacttagacatatcatttttttttcaagcataaaacacatatttttagtataaatcataataatcatcactaatatccatattaaaccaattgttacatgtaatccatgagttcctaataaagtgaaaaatgcagataaaaatgcgcttttttcccatgtatttccttcaaggaataattgataaaattcatttatttccattgaaataaaaatgagaccaaaaataaaagtcatagttaaccaaaatatagtttttattttattataagaatttttatacatagatatcatggtcataccaaaagtaaaactactagttagtaatactattgtttcacaaaaaacatatgaaagattagaaatattttgaatattttcccctccaaaagtatttttatgcaaaattatatatacagcaaataatgtagaaaataagacacaatcgctcataatatagatccaaaatccaaagatttctttagaagacattatttctttatttaattttttttttattttttccatattttaagcctgatttatttaacaatttattttttttttagatacatctacatagtaatcaatgtcaaaattaaaagttcttataattatacttaaaataatagcaattgcagaaataccaataagccaataaattttccatactatagaaaatcctaaaaaactagaaaaaaatcctattataaatcctgtacttgtttttttaggcatatgaaatgttttaactatatgttttttattattgaaattatattttaatttttcttttttttcccaaaaatcatctcgatatgtaattttaggtaaaataagaaagttataaaatttaggtggagaagatatagaccattctaatgttcttccattccatgggtcattggtagaaatataattgatattttttctatttttaaaacttacaatcaattgtattatttgaaataatattcctattccaagtatacaagttcctaaggatgctacaattaaataagggtgaaatccactttctatactataatgatataatcttctggtcataccttttaatcctaaaatatataaaggaataaatgctatataaaatccaattaaccaaaataaaaaagcatattttcctaatttttcatttaatcgaaaaccaaatattttaggaaaccaatatgttaatccagcaaaatatccaaaaactactcctccaataatcatattatgaaaatgagcaactagaaatacactattatggacttgaaaatcaattcctggcacagccatcataactccagtcataccgccaattgtgaaagtgattataaaaccaatagtccaaagaatagtggaatgatattctatttttcctcgaaacattgtaaatatccaattaaataccttaacacccgtaggtattgatataatcattgttgcaattccaaaaaatgcatttacatttgcaccagcacccattgtaaaaaaatgatgcagccatactataaaagatagaaaagttatagcaactgttgcccaaaccatggaagtatatccaaaaagtttttttttgcaaaaagttgctgtaacttctgaaaaaataccaaaagcaggtaatataagtatatatacttcaggatgaccccatgcccaaatgagattaacatacatcatagcatttccacccatattggctgtaaaaaaatgcatatgaaaaaaacgatccataaataacaaacctaaagttgcagttagtataggaaaggcaataataacaaggatcattgtacataaagttgtccaacaaaagattggcaatttcataaaactcatgcctggacatcgcatttttatgatagtaacaaaaaaattaatacctgataaaagagttcctataccggatatttgtaaagcccaaatataataatctacaccaacaccgggactgtaaattattccggaaagaggaggatatgccaaccatcctgtaccagcaaattttcctattacaagggaaatatttaccaaaaaagcacctactaaaaataaccaaaaacttaaagaattcatatatggaaatgcaacatcacgagcaccaatctgtaatggaatagcaatattgactaatccaaacataaaaggcattgccataaaaaatatcataattacgccatgtgcagtaaaaatttgatcataatgatcgggaggcaaatatccaaaagaatgtccaaaagaaaaaacctgttgtaaacgcattaatatagcatctgaaaatccacgtacaaacataacaagtgctgaaataatatacattattccaatttttttatgatctacagtggttatccattctttccataaccatgtccattttttaaaataaaaaagcataaaaattattgttaatataaacaatcccataaaaatgttggcacctataataataggattactaggtaatgcatttaaacttaagtttcctaataatctcataattaaaatttccttatatttattttaaatttataaattttgatttgatattaaattactagatttatactttgtatattttttaattatatctttgtataattgattattttttaatatatatagagtaacagtatttgcaatactaggttttgaaagttgtaaatattgattcttatctaatataagaaatgtttttttttgaatttgagatatccaattttcaaaattttttaatgaactaacatgaacagaaaatttcatttctgaaaatcctattccactataattagttgaaaatcctttatatatacctttttcatttgctatcaaatttaattgtgtttgcatacctggcatagcataaatttggctacctaactgaggtataaaaaaaccattcataggtgcatctgctgtaattttgaattttattggaatattaacaggtatttgtaagaaattaattgtagcaatatgctgtttaggataaataaaaagccatttccaatttagagcgacaacttctattaaaagtggttttttttgaaaatttaaagatttaaatggatctaatttatgggtagtaatccatgtgaaataagataagattaatataataatacatggtattatccaacatattaattctattaatattgaatgcgaccaatttggtttataaagagtttttttattagattctcgaaaatatattgatataataatcgttataataattactggtattattaataataacataagaaaaactgtaaataatattaatattttttcttgagaagctatataacctttaggatttaagatttctaatgtacatccagataatattaagaataagaaacatattattaaaataaataatatttttttactaaaattaataaaaacggataatttataattcaattgcaatctctccaaaataaaatattaataacaatatcgaattttactttttaatactaaatattttttttataaaatttccccatacttttttgaagtatataaaaaaaaattaaattgacccaaaatagttcctattatcaaaagtgatatttgatataaagggaaaatacataagatgcgtaatggccaaaatatataagaaatagtatggtttttatcaaatcctattattttcataaaaatatccgcaatatacatagaaaaaaaacctgatatggaaaaagttaataaaataagaaaaatttgataatttttttctactttccaatattcttttgtaaaaaattttccaatattcattacgaagtaaataaatttaacaatgttactaatcttagtttttaaaaaaaataaagtaaatatataatatttaaaatatttttgttaaatttaatgtaaagataataccagagcaaatatagcaaaaataaaaataaaaattataaaaaaaccattacaataaaaaggaggatatagaataattttttttatatagatagcactaatattcattagtgcaggaaaaataattaaaataataatacataatattcctatatattgaagtattggtataaataatccaggatataacattactattatagtaggaggtatgaaaacaatatttatggataaaaaatgaaatatttttttatattgtttaattttttttttagggaaaatatctaaaataaaatctagcattgataaactaacacctaaaaaagatgttgttatacatattgacataaatatatgaattaaaaattgaatatatattgaattaagatttttgcataaagaattagataaataaaaaataatatttttcgattgtgaaatcgaatataattcaatactatctaatgtagaacgaatagaatatatccatattaaatataatattaaaggaataatgcttcctaaaattattactaataatattttttttctttttttttttaaatatatgctaatagatggaataataatagaaaatccaaaagcactaatgataggcattataaaatttaaagaatttacatgataaatgatagaatttatattttttatagattcataaggaattaacataattaaaagcaaaaaaaaggaacttaatttaattgccattaaaaatcgatttgaccaatctacaatttttataccattataaaaaacaaaagaaaatatggttataaataatattgtggacatataattatttaatttatatcccaatagttggtataacaaagattttattaattcacctccaccttctaaatataatgataaaagaaaatacaataataacatatatagtatgcccataattatagcaccagattttcccagtgttgattgggccatagtaattaaattagaattaccagaaatagataagtttaattccataatccaaaatgcactaatcatcattataaaacatatactaattgatataagagtaataattttcaattctataccattagtaactataggtaatgcaagaatgcttcctccaactgaaattccaattataaacaatgttgatcctaatatacgattaaacatataaaatccagataatattttatcgataaatattatctgtataataaaaattgtctatagataagtttttaggattattttttaaattttattaaaaatcaggtgaattttatgtttaaaaataaaattattggaggaattttaataatttctggaacctctataggaggcggaatgttaggattgcctattattacttctgaattaggagagttttatacaatattattgcttttcttttcttggggattaatgactattacagcatttcttacgttagaagtaaacttatgttttcctcaaaagagcaatattccatctatgatggaaaaaacattaggaaatttagggcttataattggttggtcaatttatattttatttttatattctttattatcagcttatatatccggtggaacagatatttttcaaggtttttttatatttctgggattacatttaccttattggttttcagggttattttttgcaatcttttttggaatcattgtaatgaaaggaatatcttttgtggataagtttaatcgattttttatgacaataaaaatattatccttattatttttaattttttttattttattatcgaatatgaatgaacataatttttttccaaaaaaaatattaaatattgccccttctatatcaatttctattacttcttttggtttttctattgttgttcctagtttgcgaacatattttaaagacaatattcaatctttaaaaaaagttattttttttggatcgttgattcctttatttttttatattatatggattcatgttattttttctaccatacctttacatggagaaaatggattaatttatattaaaaatagcttaaatcctattacaacattaataaaaagtttacatattataaccaagaataatagaattcattttttttcccatttatttatttctatatgtattataactgcatttttgtgtgtttctttaggattatctgattatatagcagatggaatttcttgtgaaaagaaaggtattggattttatattatagcctttattacattttctcctccattatttttattattatttttttcaaatacttttatatactttttaaaaatagctggaatgttatgtatattattacaagcgattttacctatttttatgtcatggaaagtccgatatcatcaaaaaaaaatttttttttatcaagtatttggaggaaaaactatattaataatatctttaacttgttctataataatttttattttttctgtaaattctttgttttaaatatgtatatttattcattaaattaaaaatttaatttaatcaataaaaaaaaataatctacaacactatttcaatatttaattaaattttaaatataaattatatcgttattttattaaaaaattaataaaattcattgtatgtgaggatagatttggattaatgagagggatataatgaaattatattttttatttataatataatttaatttaaaggattcttatttatgaatgatataggaaaaaatattctagtttggatacttataattattgctcttttagcaatatttagtaattttgctcctaatatgggtacccgtattgaaaaaatgacatataccaatttaattcataatattaaaaacaatcaaatagagagcgtacaaattaatcagaataatattttaggaaccacaaaagatggtagatattttaatacttatattccttggaaagatcctattttgcttaatatgatgataaatcataatgtagaaatagtagcaaatccaccatcaaaacgtggattttttttaagtatattaattaattggtttccatttatattgttaataggagtttggatttttattatgagacaaatgggttctggaaaaggaggaggagcattttcttttggtaaaaacaaagctaaattaatgaacgaagaagaaattaaaacacgtctatcagatgtagaaggtattgaagaagcaaagttagagataagtgaaattattgattttttaaaagatcctgatagataccgaaagttaggcggaaaaacacctcatggaattttaatgattggatcaccaggaacagggaaaactttattagcacgtgcaattgctggtgaatctggcgtgccttttttttcaatttctggatcagattttgtagaaatgtttgttggtgttggtgcatctcgagttcgagatatgtttaatcaagcaaaaaaaaaagctccttgtattatttttgttgatgaaatcgatgcagtaggtagacatagaggcacaggacttggtggaggacacgatgaaagagaacaaacattaaatcaaatgttagttgaaatggatggttttacagaaaatgaaggaattattgttatagcagcgactaatcgtcctgatgttttagatcctgcattattaagacctggcagatttgatcggagagttattattccacttcctgatatgaaaggaagagaaaaaattattcgtttacatatgaaaaaattacctttagatcaaaatgtaaaaccagagtttattgccagaggtacaccaggattttctggagcagaattagcaaatttagttaatgaagcagcattgttttcggctagattaaataaaacaacagtaagtatgaatgaatttgaaaaagcaaaagataaaatcttgatgggcactgagcgtcattctttagcaatgaatgaaaaagaaaaatatattactgcttatcatgaatctggtcatactattgttggtttattagtaccagatcatgatcctgtatataaagttagtattattccaaggggtcaagcattaggggttacaatatatcttcctgaacgagattatatgagtttctctaaacaaaaaatagaaagtcaattatctagtttatatggtggaagaattgctgaagaattaatttatggcaaacaacatataactacaggagcatcaaatgatatagaacgtgcaacagaacttgcaagaaatatggtaaaaaaatggggattttcagataaagttggtccattaaaatatagtgaaaataataatcaaccatttttagggcatactataggaacatcaagtgttaatgatttttcggataaaactgctatagaaatagattctgaaattcgtaatattattaatattaattataaaagagcaaaaaaaatattggaagataatatagatattttacatgctatggcaaatgctcttatcgttcatgaaacattaaatgccaaacaaattgatgatatcatgaatcaaaaaaataaaaataatggaaaataataattatgtgttattttttttcaaaaatagtaaaaaaaattcctaaaattatgggaattttaaatgcagatccaaaatcttttattaaaaatagtcaagtatttaatactgcacaggctatagataaaacttataaaatgataaaacatggagcagatatcatagatattggaggagaagcaactaatcctaaaattactaataatagcagagaaaggataatctctgtagaggaagaatgtgatcgtgttattgatattattagtgctatccataaaaggtttcatattgatatatctattgatactagtcatcctaaagtaatgaaaatggctgttgaaaaaggggcgaatatgattaatgatcaacgcgcattaactttaccaggcgcattggaagaagtttcaaaattaaatgttccagtttgtttaatgcatatgtttggaaaaaataatccaaataaattttatcatattaatgattattataaaatgttaaaagaaatatctttatatcttaaaatgcgtattaaaaatgctattgcaaagggtattaaaaaaaaaaatattattattgatccaggtctaggcgggggtatttacggaaaaaatactaaacaaaatctttttatattaaaaaatttaaatttttttaaaaaaaatgattttcctgttttagtaggattttctagaaagtctatggtttgtgaaattataaaatcttcaccaaaaaatgccttatttggaacaattgcgttatcagttattgccatgcaacaaggtgcaaaaattataagattgcatgatataaaagaaaatattcatgcattaaaaatgattttagcaactaatttagcaggtcttgtttaatgagtttaccaaaaatatcatttttaggttgtggaaggcttggaaaaacattagctaaactttggtacaaaaatcttgtatttcaaatacaagatatattaactcaaacgtacaatagcgctgttgatgcaagaaattttataggatcaggtcgtcctgtaaaatcatataaagatattgtttcttcagattggttttgtatagcaacaaatgatatacaaatatctaatatagtaaaaaaaattaaaaaatttaattttattaaagggaaaaaaattatacattttagtggttgtttaagttcatatgtattaaacccattaaaaaaaatgaattgtgaaatagcgtcattacaccctgctcttagtttttcacaaccagaatttgcatattatcaatttccaggaacatattgtacggtagaaggagatttgtcattagtattaagaatacgagaaattatagaaaaaataggaggaaaatttttacatattaatgctcaagataaacccgcatatcatacggcatgttgtttttctagtaattttatatacagtttaatgcaatattctatttctatattaataaatataggtttctcaaaaaagaaagcaaaaaatttaagtgtttctattttatctaaatcattagatagtctcaaaaaaactaataaaatattattaacaggtcctataaatagaggagatataaatattataaaaaaacatattaaaacgcttaaaaacacaatatggtcaaagccatatcgtatgctttcattagaaattatacattatgcttctattcaaagaaaaaaaaaaaaaaatatcattaatttattgaaaaaattttagtttaatctaaacatttattaatgaataatagacaataggattgttatttaacaatgaaaaaaaaagtaattatagctaattggaaaatgaatggttcatattcatttgcaattaatttttctaaaaaattatttaattatgtaaaaaaagatgtagaaataattcttttaccttcttttatttatttatattctatgaaaaatattttacaaaaaaaaattttgctaggatcacaagatataagttttaataagtctggtgcatttacaggtgaaattagtgcttccatgttagtagatataggatgtaaatattcacttataggacattcagaaagacgaaaattacatatggaaaacaattttattgtagcaaaaaagtttaaaatagcaaaattgtatggaatttcttctattttatgtataggagaaagtttacaagaaaaagaaagagcaagagaaattgaagtcataagaaaacaaatttatgcaattttagatataattcaacctgaagaatggggagaaactataattgcatatgaaccaatttgggcaattggaacaggtaaatttgctaatccaaaacatgtacaaaaagttcatatagaaattagaaatgttttaaatgaatggtctgaattttatacaagaaatacaagaattgtttatggaggaagtattaattctactaatgttataaattttttaaaattaagcgaaatagatggatttttaataggaaatgcatctttaatatttgaagaatttttgtttatttataaattgtgtgtaaaaaaatattctaataacctactaaaactaaacacataaaactctttacactcactgcttccttccggatctgatgaattatgtaattcttttattgtaaagtggcaggtcattagaatattttttaatattaacaaaatataatatataatgctagatataaaatgtaattaaaccattttttttggagagatgtccgagtggctgaaggaacatatctggaaaatatgtatataaaaatgtttgtatcgagggttcgaatccctctctctccgccaaattaaaaaatttatattattttttagcaaaaaaaaaatcatatggtaaaatatcttaaatactataataaaaaaaattaattattaggattaaatattggcatatcaaatattatcacaaaaatggcgtccaaaaacttttaaattttttattggtcataaagaaataatttctggattacaatatgctttaaataataataaattacacaacacttatttattttctggaactagaggtatagggaaaacatctcttgctcgtattattgcaaaatgtttaaattgtgaaaaaggaatatcagataatccttgtgaaatttgtaatatatgcaaatcaatccaactaggatgtttttctgatattattgaaattgatgcggcttctcaaacaaaagtagaagatattcgtgatatattagataatatccaatatcctcctatatctggtcgatataaaatttatatttttgatgaagtacacatgttatctttacatagttttaatgcactactacgatccttagaagatccaccaaaatatattaaatttcttttaacaactactgaattaaaaaaaatacctataactgttttatctcgatgtttgcaatttcatttatatccattaaattcttttgaaattcgaaaacacttaagttatatattaaatacagaaaatattagttataatgatgaagcattagattctatttctttattagcagatggtagtatgagagatggtttaacattattagatcaagcaattactgtaggacaaggaattgtagataaaaaatcaacaaatataatgttaggaattaccaaaaaagaagaaattttttccttaatagaaacattatttaataaagaaatttctttattgatggaaaaaagtaaaagtttaaatttaaaaaatagtaatttttttttaatattagattttatggcacaagctatttatgaaataaattattatcaattgtcaaaaaaaattccatcaaatggatttttaccagaaaaaaaattgattttattatcaaaattttatccaaatcatgttcttcaaatatattatgaaattattacaaaaggaaaagaaactttaaaaaatagtccaaccatacatatgggatttaatatgatattattgcgattaatatctttaataccttttgaaataaataaaaattttcatactttgccaaagcaatcattgaaattattaaataatttagataaaaaagaaaaaaatattcaagataatcaaaaaaaaaatatgcattctgtatttaaagagcaaaaattaaacttaaaaaaaaaaaataacaaaaacaaaacatcaaatttgtatcaaaatttattaaatgataaaaatattatttttttacaatctgaatttaatgcagtaatagaaaaaaaatctattaaaaatatcacataatttttaattttatataaaaaattagtatgaaaatattagcagataaaaacattccattattaaaatattttttttctaattttgttgaaagtattgataccgtatctcccgataaattttatcaaaaaaatcttttacaatatgatattttattaattcgatctacaattaaaatatcatctgatatattaaaaaacgcaagacctaaaataattgcaagttgtgtttcaggttcagatcatatggatcttgattatcttaaaaaagaatctattatgtattatacagcaagtggatgtaattctcaatccgtttcttcgtatgttaaacaaattattaatggtttaattaataaatccttactaaggcataatgggaaaattgcgataataggtgtaggaaatattggaaaaaaaatagtaaagtttttgcagaaaaaaaactatgaaatagttcaatgcgatccatttcgtgcaataaaagaatctaaatttcctcatattcctatagaatatataactaattgtgatatgatttgtttgcatattccattaacttttgatggaaaatttcctacctatcatattattagtgaatgttttttaaaaaaacaattattaaacacaattataattaatacctctagaggaaatattatccaccctaatgtttttttttcttctcaaaaatttattttttgttttgatgtatggcctaaagaaccgaatattcccgttgatttagtacaaaaatcgtatattgctactcctcatattgctggatatactaaattaggaatatctaaaggggttcatatggcttataataaaatgtctaatatattccattggcctaaaaaagatttaccaaataattttaaaaaaaatatacataaaaatttatttcaattaagtaattccttcaaattgaatattaaaatgaaaaaaaaaactgaatatatttttaaaaaatttagaaaacaatatatgaatttttcttgaaaaaaaagaattttatccccatatgcacaccatgtgtaaaaagcaatttaataaaaaataattaaggagcatgaataattctaatgaattctaacaataaaaagtctaataaaaaagaaaattttagtttccaaactgaagttaaacaacttttaaatttaatgattcattctttatattcaaataaggaaatttttttaagagaattaatttcgaatggatctgatgctattgataaattacgatttcaatctattactaatatcaagttaacaaaggaatatactgatcctgttattattgttgattatgataaaaatttaggaattttaagtattaaagacaatggaataggtatgagtcgtaatgaagtaattgataatttaggcactattgcaaaatcaggaacaaaagatttttttaattctttaacaggtgataatgttaaagattcacaattaattggtcaatttggtgtaggattttattctgcctttatggttgcagataaagtgattgtaaatacaagacatattaatgtattgccagaagaaggtgtccattgggaatcacaaggtcaaggtgattatacagtagaaccgaaaaaaaaactacatcatggaacagaaattattttatatttaaaaaaagaacatttaaatttattagagacatttacattaaaaaatattattactaaatattctgatcatatttctgttcctattaaattacgagaagaaaaagagatccaagaaaaagataataaagataatttaaaagagaaaaagaaagataaaaaaactgaaattgtatatgaaacagtaaatttagggaaagctatatggctgcgttccaaaaaaaatattacaaatacagaatacaaagatttttatcgacatgtttctcacgattttggcgatccattatcttggatacataattcaatagaaggaaagcaagagtttgtaattttattatatattccaaaaaatgcaccatttgatttatgggatcgtgataaaaaatcaggaattaaattatatattaaaaaagtatttattatggataatgctgacattatgccaatttatttaagatttattaaaggtgttattgattcttctgatttgccattaaatatctcaagagaaattttacaaaaaaatcctttagttgataaaattaaatcattttctgttaaaaaaatactttcttctttagaaagaatgtcaaaaaaccaacctgaggattacaaagaattttggaaaacatttggacaagtaatgaaagaaggtcctgcagaagattttgataataaagaattaattattaaattattaagattttctagcacttttgatgataaagaagaacaatctatttctttagaagaatatgtaaaacgtatgaaagaaacacaaaaatttatttattacattacagcagatagttttctttctgcaaagaacagtcctcatcttgaaatttttcgtaaaaaaaatattgaagttttattacttagtgatcgtgtagatgaatggttagtttctaatgtaaatgaattttctggaaaaaaatttaaatcaatcaccattggtgaacttgatataaatcaagaaacagaaaataaatcttctgtagaaaaaaagaaaaaacatgataaaaattttgagtctattattaatcaaatgaaaaaggtattaggtgcaaaggtaaaagatatacgattaactgatcgtttaacagattccccttcttgtgtagtttcagataatacaggaatgagtatgcatttacaaagacttatgtctgcttctggtaagcatattccatcctcggttccaatttttgaattaaatcccaaacatcattttttacaaaaacttcaagaagaacaagatgatcaatgttttagtgattggactcatattttatttaatcaagcattacttagtgaagcaggaagtcttgcagatccatctgaatttattaaattaataaataaatatttaaaataaatttttaaaaattattttccctgtatattatctttttaagatatacagggaaaatgttaattaagattttaatttctttattttaagaagttttttcctttttaaccaattatataatgtttgcggatgacatcccactaattttgctatagatgctttagaaattcctaaatttaaatattttttgatatcattatttttaatgtctaatttaagatttttatttttacttcctttgggtcttcctaaaggcatgccagtttcttttcttttagcaagtgcttgggaagttctttttgaaataaaatcactttctatttttgatattaaagtaagaaataattggatatcaatatatctttgtatattatctatgcaaatattatattttacaaaataaatttttgccttatttttatagattttactaagaatttctaagacttgagatacagaacatgccaattgtgtagcatctgatataattaaaatatcttttgtttttagcgtattaattattctcccaatttcacgatgaatccaataagattttattgattcgtattctaaaataatagtatcgatagttagttttttattcaatgcatattcaaaaattaaattttcatcttgtttgtcaatatgaaaatacgcataacaggtcattccatttctcctattgcagtgcgtaatcgggttttaatctttcaatatgaagattgtataaatccgatatatttaaaaaaaatcaaaaaaatgatctatcagatttctaaaataaattagaaaaattaataaaattcaaaaaatataaaatatcataatttatattttataatatattctatactagttccttgaaatattatagaaaataatacaacagaataagtggaaaataatattatatcgtaataaggactataatttggaatagataatgccatagcaatagccaaacctcctcttagtccaccccatgttaatatagttattataaaaggagaatagttgcgataaattttaaatatattcattggaatgccaacagtaataaatcttgaaaaaagtacaattggaattgcagataatccaagaaagatataataccatttatacgataataatattatctccaatcctattaataaatacaatatataatttaataaatcttcaattaattcccaaaatatatataaatatttttttccttttttagttataatattttttgttttaaaatttcctattataattccagaaataaccatagaaagaggacctgaaatatttatttgcattgcgtaattatatccataagtcgcaatacaaaatgaaattaatacttctaattttggatcttttatcctttttattaaattataacttaatattcctaaaaaaaatccaaaaaaaaccccacccatagtttcttttaaaaaaacagtaaaaattaaatttataaatgataaatgatgattaaatatcatatgataaaacatcataaataatactattccaataccatcattaaataatgattcacctgatatttttgtagttaaatctaattttgtagagatttttttagttgtggataaaacactaataggatcagtaggagaaattatagatccaaaaattaaacaataaatatatgaaattgatattttaaaaaaaaataatatacaataaataattgtaccaattaaaaaagtagaaaaaattgtggtaataaaagctagtgaaaaaatttcccatttataatctaataattttttcaaattaatagataatgaactggaaaataaagataatcctaaaattatatttaataataaatttttaaaatcaactttttctaaaaagaattttatagatgtttcaaaattaaaaaaagacattttatttgcaaaaattataattaaagaaaaaaaaaacgcatgaagtgttattgcagtagtattttgtatatttaaataaatataatttatatagtatatgaaaacagaaaataatagcaaaatagaaagcatataataatattgcattttagaaaatatttaaattaggaatgtttaagaaactataacatatatataattttaaattataaaaaaatattttagcattgaacaatatgtttattaaaatattatttaagtaatatttttatttaaacttaaattaattatataaaaaaataatgattaaaatttttaaaaaattttaataaatacattactaaataattgatataatatttagtaattttgaattattttaatattataaatattattgtaaatagaattaaaaatttaggtaaataaaatgtctgataaaatatataaaaaatttatgtgtgtactttgtggatatatttatgatgaaagatatggttggccaaaagatggcatacaagcaggaacaaaatgggaagacgttcctttaaattgggaatgtcctgaatgcggtgctatgaaaagtgattttgaaatgattgaaatttaaaatctaacaattttctcttaatttcatggtaactaattcctcactaatagtaggatgaattgcaattgtatgatcaaaatcttttttggtagcaccaatattcattgcaatagtaattccttgtaacatctcatcgcagtttaatccaataatatggcaaccaattacttcttctttgtctcctaaacatattaatttcatagctgtttttatattattcatagctaatgtatcatacatagatttaaaagatgtagtatatattttaatattttctttgccatatttagaaatagcaaatttttcagaatatcctacacttgctaaaggaggatgagtaaatataattgtaggaacatatttataattgatataaatattttcttgattaaataatctttgagataaataacgacctcgttttaatgctacaggtgttaaattgtaagtatttgttacatcacctagagcatatatattttttactgtagtttgttcatatttattaatttgaatagcagaattttttaaacaaatatcagtattttttaaatttaaatgagcaatattaggagatctcccaatagcccaaattaaacaatctatattagaaatagatattttattttgtaaataaatagttaaattctctgtattattttttttaacttgaataattttattttggggaattacagaaattttcttttttaatatttccattaaagttccacctaaaatatcatcaaattttcttaaaaaattcttatatcttataattaaagttatttgacttcctaaggcatgaagcatacatgcaatttctaaagcaatatatccagaaccaacaatgacaactcttttgggttttttatgtaatttaaaaaaatcatctgaagtaattccgtattctgctccatatatattaggtatcttaggagaactaccaggtgataataaaatatattttccggtatataccatatcattaacaataatatgtttgttatttttaaattttgcatatccttggattaattttatattgttatctgtaattttttttttataaaaattatgaatatttttaatataagtatttcggttctttattaatttttcccaagaaaaattgatattttttttttgaaatgaaaatccataatttatactttcatgtaacatagaagacaacatactaccaaaatacataattttctttggaacacatccatgatttacacatgttcctcctaaatttttacttccttcaattattccaactttaacattatattttgaagcttgtatagcactggaaattcctccagaaccagaaccaataacaagataatcaaaactatttaccattttattttcctttatcttcattttattttcctttgtcttcaatataggcgaaagctgaatgattatgtatagattctatattttcacattcaacagaaaaatatccaattccagaacacttttttattgaaagagaaatatctcgtactatatcttcaacaaacttaggattttcataagcaatttcagtaatatacttttcatcttctctttttaaaagagaaaatatttgagaagatgcatggttttcaactaaattaataatatcatcaaaacagatttttttcgataaaatttctgcatttacagtgatataagatctttgattatgcgctccatatttagaaatagcttttgaagatggacataatgttttaacaggtatttgaatttcaatttctctatttattctagatggtgtatgataggaacatttaatttttgtattatatgctaatttacttttaaaaaaacttttaggagatttttttattttaaaataaacaaactcaatttgtaattgcgaagaatgtgattcaagtttatcacaaaatttttgcataattttttttaaatttcctatagatacaggaatgttgctgattgattctaaaacttcaataaaacgtgacatatgaacaccttttttattttttgataaagtaatagatatcgtgtattttcctatactattttgtttttcaaaatttttatttgcaataattaaaggatatttaagatctttaatacctactttatgtatagataactttcgattttcttgaaaatcttgcatatcaataagattagacatatacaattaaaaaaaattgttttaatgtataaaatactttattagaatttaatatgaagttcaagtagttagaaatttatttaaaataataaataaaaatattatatagatttattttttaataaattattataccttattgaaaattggttttgtatttaatattgagttgagtaaatattatgaatataaataaaaaaaagttttttattagttctttgttgataatatctttaatttctatttttataattatttttatgggaaaaatatttataaagtcaaaaattacaaaatttataaaaaattatcagcctgtttcttcagttacaacacaaaaatctaaaatttacttttggaattcttatatagaaagcctaggtattattagtccaataaatggaataaatatttctgcaataaacaatggaaaaattgccgcaatattatttaaatctggagatataataaaaaaaggacaaccattactattaattgatgatactgtagataaaacaaatttatttgaagcaatagcagaagctaaattagcaaaaatgaattatattcggcaaaaatttttatatgaaagacatataatatctaaatctattttggataaaactaaagcagtcctattaagtaggatagcaaaaataatacaatataaaaatattataaatgaaaaaaaaattcgtgctccattttctggaaaaattggaatttttaatgttcatgttggtcagtatattgcttatggtgatattatcacttatcttaaatctatcggacctacttatgtaagttttcaaataaaagaaaataatatttctcatatatatattggacaaaaaatcataattactatgacagcttatccaaatacaatttttaaaggcaaaattactgctatagatacattattatctaataatattaaaagtataaaagtacaaggaattattaataaccctcttaagaaggatttattaccaggaatgtctggcaatataaaaatcatactttctacaaaaaataaagttattgcaataccacaagaatctatcgtatatactttatatggaaattttgtttatacagtttctgaaaaaaaagatcataaaaataataaaattaaaacttatgcgaaaagaacatatataaaacttggggaacaaagagaaaatttaattgcagttacaggaatcaaaaaaggagaaaggataattattgatggacaaacaaaattacatgatggatctttagtaagaattgttacagattctgtgaataataaatctaaaaaaaataaatttttaaattaaatcttaaaaaataaaattttaaacttttttcaaaaggttatcgcatgaaaaatttcacaaaaattttcattaaacgtcctgttttatcttctgtagttagtttattaatcctaattttaggagttagcagtatttttaaattgccattaagacaatatcctaagataaatagtactactatagttatttctacattatatcctggagctaacgcccaaattgtacaaggttttgttacaatccctttagaaagatctattgcaagctcagatggaattgattatatagaatcttctagtatcttaggattaagtaatattactgtacatattaaagttaactataacattgaaaatgtcttaaacgatatatcaggcaaaataaacattattttatctcaattaccaaaatcatcaagtaaaccatctattattaaatctaatatgaatattatgccaaatattattttaagttttaataataaaaatatgtctccagaagaaattacaacatatttaaataattttattattccagatatatatagtgttggaggagtttctcaagcttctatttttggagaaaaaaaatattctatgagaatttggcttgatgccaataaaatgcaacaattaggagttactcctattgaagtatacaattctcttctaaagaataatattagtacaactgcaggacaattaaaatcaaaatatatgtatattgatataaatattgatacatatatcaaatctgtaaaagattttaataatatgattattaaggattatcatggacatttagttcgtatgaaagatattggaaaagctgttttaggacctcaatcatatagaacaaaagttttttattcaggaaaggaatcaatatttataggaatttcaagtgcatctaattcaaatcctatctctgtaataaaaaaaattaaatataaaatttctttttggaaatcacattttcctcctggaatgcaggtaaatattgtttatgatggtactaaatatattcatacatccatttacgatgtaatatatacaataatagaatcttctattattgttgcaatcgttatatttttatttctaggatcttttcaatcagtatttattcctatgattacagtgcctttatcattaataggtgtttgttcgtttatattttttatgggattttccataaatttattaacattattagcgatggttttagctataggattagtagtagatgatagtattgttgttcttgaaaacgcacatcgtcatattaaaaaaagtaatttatctccaataaatgccacaattaaagcttctcgagaaattactaatcctattattataatgactacaacattaatcgctgtatttgcaccaatcggttttattagtgatattacaggatctctatttagagaatttgcttttactttagcaggggctgttttaatttctggtatactatctttggtattatcgccaatgatgtgctctaaaattattagtaaaaaaacatttcaaaataaattagtacagtttatagaaaatattttatcgaaaatacgtaatttttatgaaaaaatgttaaatttagtattaaattatcgttttactacagctataatgggttgcttaatatttattagttgttatttcctatttataggaactacaaaagaatttgttcctattgaagatcaaggatatataggaattataggtataggaccaagttgggcaaatttaaattatcttacgaagtataattctcaaattgaaaaaattttccatacctttcctgaagtcaaagatactttttctattgatggaattatacctgattctcatagtatattttctgctatgattttaaaatcatggaataaacgtgaaaaatcacaaatgataatagcatctcatgtaaatcaagaattacaaaaaattacaggattacaagctgtagcaattcaatttccttcgcttccaggtattccttatggtcctggagtccaaatagttttaaaaactgcatcagattataaaaaattatatatgttatcagaaaattttataaaacatatcatgaagaatgatatgtttatttatgccaataatagcttgaaatttgacaaaccattattaaatattcatatttttcgggacaaaacaaatatgttaggcattagtatgcaagatattgctttagctatgtctgttatgattggaaataatgcttataattattttaatatccaaggaaatacttttgaagtaattcctcaagtatttccagattttcgaaaaaatccaaatgctttaaaaaatatctatatatctactcaatttgggaaattaattccaatttatgatttagtaagtatgaaatatacttctcaaccttcttcgttaactcattttaatttattaaattctacaactattcaactagctatgaattatggaattaaaatagaagatgcagttaaatatataaaaaaggaagcaaaaaaaatattaccttcagatattacatataattttataggttctgcaagaaaatatttacatgaaggtaatacactgctttatacctttattttttccatgattataatttatttattattatcagcacaatttgaaagttttagagatccttttattattttagtttctgtaccaatgtctatttgtggagcattaatgcctttatatttaggatttgcaactattaatatttatacagaaattggattaattacgttaataggattaattagtaaacatggaattctaatgatagattttgcaaatactctgcaaaaaaaagggggatatagtatttataaatccataaaaactgcagcaaaaataagatttcgtcctatttttatgactacattggctatgatatttggcgttattccattaattcattcaagtggagctggatcaattagtagatataatataggattagttattttttttggtatatctgttggaactttttttactttatttatagttcctgtaacatatacttttttagcaaaaaaacataataaagaaatatagttttatgtaaaaaagctaactaaacaatcgctactttatatttattaatttagtagaggaaagtccgggctctatagggtggcatgccaggtaacacctggacatcgtgagatgatggaaagtgctaaagaaaagtaaaccgcctatttttttaggtaaggatgataaggaggtgtaagagaccaccgcatttatggaaacaaaaatggcaaggtaaaccccatgtagagaaagaccaaatagtaatgtaattacgtgacccgcgtaaaacatttgggtatgggtcgatagaatataatagcaatattgtatcaagataaatggttgttttagacagaatccggcttatcggttagcttttttacttttttaataattattattttgataatattaacttaaaaaaaaattatattaaaaatttttattttgagccataaacctgttttattaaaagaagtattaaatattttagaaattaaaaaaaatggtatttatatagatggaacttttggctgtggtggacatagtaaaggaattctaaaaaaattaggagaaaaaggaaaattacatatttttgataaagatatggaatctattcttttagcaaaaaaattacaactaaaggatcctcggattatagtacatcatgattcgttttctcaaatatacaaacttgaaaaatatcaaaaaaaaatagatggaattttattagatttaggggtttcttcattacagattaattcagctaatagggggtttagttttttaaaatcaggtcctttggacatgagaatgaatatttcttctggagaaacagcagaaaatcttttaaaaaaaattaaaaaaaaaaaattaattaaaatattaaaaaaatatggagaagaatataaagcaaaatatattgctcatgaaatattagaagaaagaaaaaaaaatcctattcaaacaactttgcaattatctaacattattaaaaagagtacttttaataagtataaccataaacatcctgctagaaaaacttttcaagctttgcgtatatatataaatcaagaaataaaagaattaaactcttgtataaaatatattccaaaattattaaaatcaggtggaatttttattgttataagctttcattctttagaagatcgcataattaaaacacaatttaagaattggataaatttaacaaacgattatccagttaaattacctgtaaaagaagaaataatcgaaaaaaaaaaatattttaaatggaagattaaacgtataaaaccttctaatattgaaattaatataaatcgtcgatcaagaagtgctatattacgtgcaataaaaaaaatataaaaatatataaaattttaataatttatatattatctagttgcatttttttttatttcaattagaatttcttaagagcgattaagtgcggggtagagcagtttggtagctcgtcgggctcataacccgaaggtcgttggttcaaatccagcccccgctaccaaaaaatttattttcattgcaatataagaagttcatgaattcgtatggtttttattatgttaatggtatttatttaaagaataataatgttattatcaaaaaaggaatatgaaatttttaaattgctaaatcctacaataaaaggtctaggttatattctttggggtattaaactttttcataaaaaaaaaaagttatttttaatagtattcattgatcataaaaataatatttcaataaatgattgtgaaaacgtaagtaatcaaattagttatttattagatattgaaaatattatacaaaaatactatatactagaagtttcttcaccaggaattaatcgatttttattttttccttttcaatgtcaattttactataataaaaaaataaaaatatggatgtattctgatacagataaaaatattataattggttttttaaaaaaaatgtatcaagattcaattcttattaagaaaaaaaaagaagaaagaattttattttttcattctataaagaaaatacaagttattttatgattctgatctttaaaaaatactgaggagaaaataatgggaaaagaattattattagtgattgaagcagtatcaaatgaaaaaaatattgatcaagaaagtctttttcaaggcatagaaaatgcaatagaaatggcaacaaaaaaacattataataaaaattggaatatacgtgtaaatattgatagaaaaacaggaaaatacaacacttttcgatgttatacagtaattgaagataataaagtattggatgatatggaatcttatatatatatcagtgaagctaaaaaagaatatcctaatataaaaatatcggaaataattgctgaacaaattcaatcggtagattttggaagaatatcaacacaaattgcaaagcaaattattatacaaaaagtgcgtgaagcagaaagaaatcgtattgcaaaacaatataaatggaaaattggaaaattattgcatggaacagtaaaacgtattacacgtgaaaatatatttttagatttaggagaatcagttgaaggcataatgccaaaaaatgaaattttaccaggagaattttttagaactaatgacaaagtaaagtcttgtttaaaagaattatataaagataaaaaaggatcaaaattaattttaagtcgtatctcgcctgaaatgttaatacaattattttatattgaagttccagaaatcgcagaagaaatcatagaaataaaatctgctgtaagagatcctggacaaagatctaaaatttcagtaaaaacaaatgatggccgtatagatcctgtaggagcttgtgtaggaattcgtggttcacgtgtacaatctgtatctaatgaattaggaggcgaaagaattgatattgttttatgggattcaaatatagcaaaatatgcgattaatgctatgtctccagctgaagtacagtctattattatcgatgaagataaaaaaaacatggaaattgtagtagaagaaaaacaattatcacaagcgattggcaaaaatggacaaaatgttaaattggcaagtcaattaattaattggaatcttattgttactacaaatttagaatctcaaaaaaaaaaggaaaaggaatcacaatatagtataaatttattttctcattctttaggaattgaaaaaaaaattgcccatataatagtagattctggaataactacattagaagaattagcatatgtttcacttgaagaagttaacaaattgaacattcttgataaaaatatttttcaaaaacttcaagaaaaagctaatactttattattatcacaagcattaaaaatagataaaaaaaaaccttctaatgatttattatttatggaaggaatggatatggaaactgcaaaattacttgtagaaaaaggaattttgtcaagagaaaatcttgctgaacaatcagtagatgatttattagatattggtattaatcattcacgcgctgcaaaattaattatgactgcaagagctccttggttttctgaaaaaaaaatcccttgtaaaaaataatattataaaaaatctaaatataaaggtaaaaataggtagaaatatgccaaatataactgttcaggaattagccaaaaatattggtattacagaagaaaatttattgcgaaaattatgtcaagctggtttgcctcaaaaaaattctctagattttatatcagatatccaaagaaaagttcttcttggttttattagaggtacaaatattaagaaaaaaattactttacaaagtaggaatattagtaagattaaaataattggacaaacacttaaaacaattaatattgaggtaagaaaaaagaaaatttgtactactgatatagaaaagatcaaagatagtaatatagaatatcaaaatcataataatttatctatcaaaaatttagataaatcatatcacaaagaatataaaaataatacaaaaatattaaatacagtatctttacaaaaagaaaatattcaaaagaaaaaagaaaaaatagatcagttaaatagtaaaaattttaaaattgaaaaaaaaaacaaagatttaaatatgattgaaagaaaaaagaaaggattaattaaatctcaaataaaaaattcatcaaaagtagatttattaaaagttttagatacaattcaagaagatgaaaaagaagacactgatatatatcaaaacaaaaaaaattttttttctagaaaaaaaataaaaaatatagagaaaaaaaattctaatttttttaaaaaacatattttaaaagttaaaattcctgaaaaaatttcgatagaaaatcttgcaaaaaaaatttttgtaaaaaaaaagaacttaaagaaaaaaatgttagaattagatttaataaattctgaatatacaaaacatattaatcaggaaattgctgcattaatagtagaatatatgggtcatgaacctattttaataaacaatgattttttagaaaaagaattgttacatcaaaaaaaaataaaaaaaggaaaaaaaattagtagaccacctattgtaactattatggggcatgttgatcatggaaaaaccactcttctggattctattagaaatagtaatattgttaataatgaatttggcaatataactcaacatataggaatttatcccatcaaaaataaaaaaggtattataacttttttagatacaccaggtcatgaagctttttcagttttaagacaacatagtgctaatattgcagatataattatacttcttatcgctgccgatgatggagtcatgccacaaacaatcgaaagtattaaatatattcaatctttaaaaaagcctatcataattgctattaataaaattgataaagaaggagtaaattttaaaaatattaaaaataatttacttaaatataatattattcctgaggaatatggaggagaacatatatgtataaacatatcagcaaagaaaaaaattggcattgatgaacttatagaatctatttttttgcaagcagaaatgatggatattacgtctaccatgaatattcctgcacagggaatagttatagaatctaaaatagataaaagaataggaaatattaccagtttaatagtaaaaaatggaattttaaaaaaaggagatcttcttgtttgtgatacgcaaatttctcgtatacgtttaatgatggataaatttggaaaaattatacaaaaagcttatccttctatacctgtagatattttaggtttttctaagcctataagttctggaataaatttttatgttctaaaaaatgaaaaaaaagctagagaaattactaattactataaaaataaaaaaaatatacaaacaaaaaatattaatactaatcaaaaaaaatattctaatttatttgataaattatctcacattcaaaatgaaaaacatatttctattataatcaaagctgatagacagggatcaatagaagtaatttctaatgcccttttacatttatcttctaataaaaaaaatccaacattaattaaaattatatcaaaaggtataggagatattaaagaatctgatgttaatttagccaaagcatctaacgcaattatattaggttttcatgttaatgctaatgtattagctaaacaaatagctaaaatttataaaattaaattatatttttataaaataatttataatttaatagatgatatatctaaattaatatttcatatgatctctcctaaaaaatataacaatattattggttctgctgaagttaagaatgtttttcaatttcaaaaaaatggtattgttattggttgtatagtaataaagggaattataaaaaaaaattctttattacaaatatttcgtgatgaaaaaatgatttataaagggaaattagaatctttgcgttattttaaaaatgatgtaaatgaagttaaagaaggtcatgaatgtggtattagatttaaagattataataatattcaagttggtgataaaattaatatttatgatattattaaaaattaagaaaagattttaataacacaagttatgtttaatattaatagaattcgtaaaatagaaaatttattttttatgattttatcggaatcttttataaaaaaaattaaagatccgcgtttgaatttgattcaaataactgatgttgttttatctaaagatttatcgtatgcaaaaatatattttaattgtattaaatatgatacatcgattaaaattgtagaaaaaactttaaaaaagtctacaggatttattcgaatgcttttagcaagaaatacaaaattaaagtatattcctcaattgcattttatatatgacaacataccatataaagcatataatttatctttacttattgataaagctttagaaaaataaggaaaatttaattttataatgaaaaaaaaaatgtaattaataaaatattattattaaataaacctccaaatcttacatctaatcaaattttaaacaaaataaaatttaagtttaatcctttaaaaattggtcattcaggaactcttgatccatttgctactggcatgttggttttatgtttcggttctgcaacaaaattaactcaatatattttagaagatgataaatcttatagtgctatattaaaattaggtgaagaaacatctactggtgacaaggaaggaaatattatcagtactcttcctatacctaagaaattaaatttaaaaaaaatactttatttagaaaaaaaatttactggaatacaatatcaaaaacctcctatgtattcagcacttaaatatcatggaattccattatataaatatgcacgaaaaggaattactattttcaaacctaaacgaaaaattattataaaatcactaaaaatatattcatattcatgctatccaaataaaattatttttcatactatttgtagcaaaggaacttatatacgcattttagcagaagatttagcaaaagaactgggaacagttggacatttaattgccttacacagaaactattatagtagatttaaatcttataaaatgcatactttagaaaatttaaataataaaaattttctagataaattaataccaatggattctggaattttaaaatgggtaatttataatgctaatataaatgaatggaaaatgttatattatggaataaattttactttatctaaaaatattaatggatggatacgtatatattttaaaaaaaaattagtagccatttcttatatgcaaaacggaaattttataaaaaaaaaaatattatgttcttcgcattttatacgaatttaattttttaatttttaattcaattagatttctttctattccaaaaatagaaggcatataatatatattaactttatatccgttattttttattttttttatatcattgaattttatttttttttgcataataagtatttttatatttttatgaaaaatatgataacaatattttgttaaatttaaaatattaaaacaagcacgactagtaataacatcaatattcatattattttgagtattataattttgaatatttccataatatatttggatattagataattgtaattctatttttatttgttttaaaaaatggtatttttttttattcttatcagtaagttcaaaaaaataattaggttttactatagctaatggaattgaaggcaaaccacatccagagccaatatcaagaatgtttttcacgttttttatatgtgaaattatagaaagactatctattaaatgtaataatattgcatcagaaatatttttaactgccgtgagattgcatctcttattccatttaaataataaataaagaaattctatacattgatttttttgataatttgttaaaaaaatattcctaatacgaagatatttttctaatttttttttatataatatatccatgtataattacaattgtttttataatactattaaagcatatctaaattctagattggcttatctttaataataaattaatatctaaaataaaatatatatgaatttgaaaaataattaaaattaatattatgactatacaaaaaatttctttaatgcttgtagaaaaaagtatgattactttatcagtaatgaattgtaaatttcgatatgaaaaaaatcaatttttaaattttattcctggtcaatttattacatttttaataaatacccccgaagggaagattaaaagaagaagttatagtgtttcaagaattcaaaaaaaaagtagaattatagaaatagctatttctataattcatggaggatttgctagtgaaatatttcttaatattaaaattggtgcattttttaatgcaataggacctattggtaaattgatattaaaaaaatctatcaatattaatagatatattttaataggaacaggaacaggaattgccccttatagatcaatgctatccgatttagctttatattgtcaaaatggtataaaaattaatatttttgaaggtgttcaatataaaaaagatattttgtataaaaaagattttattttatttgataaaaaatatcaaaacttcaattttctttcttgtttaagtcaagaaaatataaaaaatattggaaaatatgaaagatgtggacgtatacaaaaacaattaattaaattaaatcttaatccagaaaaagatatgatttatttatgtggaaatcctaatatgattgacaatatatttttaattttaattaaaaaatataaatttcattccaacaaaattcaaagagaaaaatatatttctattaaataatatttatttatgtaaataatatacaaaatgataaatactttaaaaaaaattatatttaaattaaatttataaaaaaaaaaaataaactaattgtattgtatcaaaaatatttttatgcattcataatatagatttatagagtttttaccactataaaaaaaaatatttttgtttattatccattttaataattaattataattttattaaaaattaattagtaatattaactatatattttaaaggtattaaaaatatatatttttattttattattttaaataaatattttaaattcaatattatctatatcttaagatataaaaatataaaaaataaattcatattaagattgacatataaaaaaaaagggaaatttaaatgaataccttatttgaacttcttaaaaagaagattttaattttagatggtggtatgggtactatgattcaaaaatattgtcttgatgaaaaaatgtatagaggaaaattatttaaagatcatacattttctcaaaaaggaaataatgatttattgaatctaactcaacctaaaataattcaaaaaattcatcaagattttcttaattcaggttctgatattatcacaactaatacatttaattcaaatagagtttctatggcagattacggcatggaaaactatatttatcaattaaattttcaaggggcaaaaattgcacaaaaagctgttcatattgcttctaaaaaaaattcaaaaaaaatatattttatcgctggatctatcggaccaacaaatagaacagctactatttcacctgatattaatcgtccagattttagaaatataaattttaaaaaattagtcaaaatttatacagaaagcattcatggtttaatacaaggaggagttaatattttacttattgaaacaatttttgatactttaaatgctaaagcagctatttatagtataaaaaaatatttttataaatataatattgttttgcctattatggtttctggtactataattgatgcttctggaagaacattatctggacaaacaccggaagcattttggtattctattaaacatgctaaaccaatatcatttggatttaactgttctttaggttcgaaagatttaaaaccatatatttctgatatagcttcttttgtaaatacatatataagtatatatccaaatgcaggtctgcctaatgaattaggtgaatatgaacatactcctaaatatatggctaaaattcttaaaaattttgcagaatctcaattagtaaatattgtaggcgggtgttgtggaacaactcctaagcatattcaatatatttcttctgaattatttgatgttctacctagaaaattaccaaaaaataaattttatacttgtcttagtaatttagaccctttaattattcatcctaaaaaaaattttattaatattggagaaagaacaaatgtcaatggttctttatattttgcaaaattaatgaaaaataaaaaatatgaagaagcaatagaaatagcaagagatcaggtaaattctggtgcacaaatattagatattaatatggatgatggcatgattgattcagaattagaaatgtctgtttttttaaattttattgcatctgaaccagatatatcaaaaataccaatcatgttagattcttctaaatggtctgtattagaaataggattacaacatttacaaggtaagggagtggtaaattcaatttctttaaaagaaggagagaaaatatttattcaacatgcaaaaaaaatattacaatatggtgcagcagttgtagttatggcgtttgatgaaaaagggcaggcagaatctgaaaaaagaaaaatagatatatgctgtagagcatatcttttattaagaaatattttaaattttccatctgaagatattatttttgatcctaatatttttgcagttgctacaggaatatctaaacatagaaaatatggaatagattttttaaaagctataaaaaaaataaaaaatttttgtccttatacaaaaatttgtggtggaataagtaatttctctttttcttttcgtggaaataatttagttaggaaatctatgcattctgtttttttatatcatgcaataaaagaaggtatggatatgggtatattaaatagtaaagaaataggattatatgaagatattgatttaactcttcgtaatacaatagaagatgtattatttaataaatatcctaatgcatctgaaaatcttttaaagatagcagaaaattttcaattaaaaaaagaaaaatataaagaaaaagatattacttggagaaaaaaaccaatacaaaaaattttagattattctttgataagaggtattgataaatatatagaaaatgatattgaatttttaagaaaaaatatgaaaaaagcgatatatgttattgaaggaccattaatgaatgctatgaataaagtaggagatttatttggatcaggcaaaatgtttttaccgcaagttgttaaaagtgctagagttatgaaaaaagctgtttcttatttaataccatttattaaaaatgaaaatataagtaattttagaaaaggaaaaattttgattgcaacagtaaaaggagatgttcatgatattgggaaaaatatagtttctgttgtattacaatgtaataattatgaagttatagatttaggtgttatggtgccatgtgaaaaaattttagatgctgcattaaaatataaagtagatattatagggttaagtggactaattactccatcattagatgaaatggtatatgttgcttctgaaatgcaacgtttaaatattaaaattcctttgctaattggaggtgcaacaacatcaaaattacatactgcaataaaaatatttcctaaatttaatttagatcaagttatttatgttccagatgcatcaaaaagcataggcgttgtaaatttattattaaataaagataaaaaatacaattttattaattcaattaaattggaatataaacaattacaaaaaagatatattaatcaaaaaaaaaatatactatttgttccaatttcttttgcaagaaaaaatattttttatattaattggaaaaaatacatccctcctgttcctaaatttttaggtatacatacttttcaaaactatagtttatataaattagtaaaatatattgattggacaccattttttcaagtttgggaattaaaaggtagttttccaaaaattttacaagataaaaaaattggaaaagaagctcaaaaagtctataaggatgcaaatattttacttaaaaaattaatattagaaaaaattatagtggctaaaggattattaggcctgtatcccgctaatagtgttggtgatgatattaaagttttctctaatgagaaaagaaataaaataattgcaactttttataattttcgtcaacaatctaaaagaataaaagaaatatatacttcattatcagattttatagctcctaaaaaatttcaaattcctgattatataggagcttttatagtaactgcaggtatcaatagtgatttgatcatatcaaaataccaaaaaaaatatgatgaatataattctattatgataaaagcattaactgatcgtttagcagaagcattttctgagcacctacatgaattagttcgaaaaaaatattgggggtattctcctatggagaaattagatatcaatttattattaaaatgtaaatattgtggaatacgaccagcccatggatacccatcttgtccagatcatactgaaaaaaaaaccttgtttaaattattaaatgcagaaaaaaatatagaagtaaaacttacagaaaattgtgctatgattccttcagcttcagtaagtggtttatatttttcacatccagaatctcattattttggtttaggtaagattcatatggatcaattaaaagattatgcaataagaaaaggtatatctttagatattgcaaaaaaatggatgctttcccatttatattattaatataactaataaaatttattaatttaatatttagatatttatattatattaaaatattatattcttttgataatttatttcataaaaatgaaaaaatatttaatattaaacgatatagcttataattttttattaaaaacaggtattagagaacattctattcttagaaaacttcgaatagaaacacaaaaaaaattttctaaaaataatatgcaaatatctccagatcaaggacagtttttgcaatggttagttcgattaacaaaatcagaatttattattgaaataggttgttttacgggatatgctagtttagcaatgtcattggctatgtcaaaaaatggaaaattatttacttgtgatactaatattaaatggacatgcattgcccaatacttttggaaaaaagcaaaaaaaaatcataaaatttttctttatctagaacctgctataacctttcttaaaaagatgttaatggatgataatataagaagaaaagtagatttattatttattgatgctgataaaaaaaattatcctatatattatgaaatggctttaaaaatagttcgatttggtggcattattattattgataatgtaataggattaaaagatttacatattaataattctaaagattctgcaaaaactattcttcaattaaataaaaaaattcataaggattatcgtgttgatatatctatgatatatattggaggaggtatgacgttatgcagagttttataatttatagttttatttcttttaaatattgattttttaaactaacataatgcaaagcgctatatcgaaaaaaagatatttcttttttagtaagaatacgaattttttttacaggatttcctacccataaatatccgcctttaataattttattttgtgaaacaagacttccagcaccaataatagcatttttttgtattatagcaccatctaaaattacactattcataccaattaatgtttcttcctctacagtacatccatgcaacattactttatgaccaatagttacattttttccaataataattggatatcctttttcattaaaaatactagaatgagtagtgtgtaatatagatccatcttgaatatttgaggattctccaatattgatttgcattaaatcaccacgtattgaaacaaaaggccaaatcgaaacatcattatttaatacaacattacctattacaagtgattttggatcaatatatacccttttcccaatttttggatatatttttttaaaaggtctaataaatatgtcattgctcatgttgttattttataataaaataaaacaattataatatataaaaatttttttttaaccaaattatataaaaggattttatatatgaatccacatattttagtaggcatgtcaggtggaattgcatgttataaaacagtatctgtagtacgcttattaaaaaaaaaaaatgctaaagttaatgtaattatgacaaaaaatgccaaaaaatttattactccattaacaatgcaatcaatatcaaataatattgttcgatttaatacctttacaaagcatcataataaaaatgattatatggaacatattaaattagcaaaatgggcacaacatattttattagctcctgcaacagctaatattatagctaaattaacttatggttttgctgataacttattaactactatttgtttagctactaaagctcctatttctatagttccttctatgaatcaaataatgtggttaaatatatcaacacaaactaatattaaaattttaaaaaatcgtggtatagatataattggtcctgaattaggcgaacaagcgtgtggagattttggatatggatgtatgacaaatccaaaagatattgttcgtattgttatgaggaaatttttattatgaatttaacatatttaattactgccggtccaacacaagaatcaattgatcctatccgatatttaaccaatcatagttctgggaaaatggggtatgcattggcaaaagcagcagcaaaaaataattcttttgttattttggttacaggtcctactcaactaaaaatacccaataatgtagaatgtcataaaagcattactgcaaaagatatgaatactattgtaatgagagaatatattagagcagatatttttattggagttgctgcagtatcggattatactcccaagataacatatagaaataaattaaagaaatctcataattctattattctaacattagaaccagccgttgatataatcaaaaatgtttcttctttaaaagaaccaccatttcttgtaggattttgtgctgaaacacataatattgagaattttgctaaagaaaaattaagaaaaaaaaaattagatttaattgttgcaaatgatgtcagcagatctgatataggttttaatgtagattataattctatagtagtttattttaataaaggcaaaaaaaaatttcacaaagcaagtaagaataaaatagcagaaaaattaattcaatttattgaaaaacattatgataaaaaatacaaccatagaatttaaagttctagataaaaaaattggaaaaaaaataccccttcctaaggaaggtaccataggttctgcaggtttagatttaagagtttgcttaaataaacctaaaaaaatttatcctggaaaaacaatattgattccaactggaatagcaatatatttaaatgatccaaatattgcaggtcttattttacctagatctggattgggacataaacatggtattgttttaggcaatctagtaggtttaattgattctgattatcaaggcgaaattatgatttcatgttggaatagaggagaaaaaattttttttattaatcctggatatcgtattgctcaattaattatcgtgccaattataaaaataaaatttaaaaaagtagaaaaattttctctctctaaaagaggtattggaggatttggacatactggtttaatttaatattagattagatatttttttatgttattatataaaatattttttatttatttttatgtttaataagtttgtaaaatggatctgtaaaaaaaaaatatatatcagcgatactgataaatttttaatatttctcgataaaaaatatcctaaattatcttcttcgcaaaaagaagaaattaataaatataaagatattttcaattctaaaaattatttgaaataataattttataaattttatattaaaattttatttcaaataatttagatttatatttattttttttattattctttatgtaaattctttgcgtaaaaaatataagaaaatatttaggaaaattcttaataaattattttaaattctcaattaaatataatttaaaattaaataattattcccaggataatgtaccgccagtttggtattctgtaactcttgtttcaaaaaaatttttttctttttttaaatcaattaattcgctcatccaaggaaatggattttcagaatctgtatataatttatcaacccctatttgaagacatcttctatttgcaataaattgcatatattcatgaaatattttagaatttagacctaatattcctcgaggcattgtatcttcagcatatcttttttcaaggattgttgcttcatgaagcatttctcttacttcttctttaaaatttttattccataaatccggattttcttttttaatttgattaattaaatcaattccaaaatttaagtgcatagattcatcgcgtaaaatatattgaatttgttcagatgtacctttcattttattacgtcgaccaaatgataatatttgtacgaatcctacataaaagaatataccttcaaatacaacataaaatgcaattaaatcacgtaacaattgcaagtctgtttcaaaagtaccggttttaaaagcaggatcgctaattgctttagtatattttaaagaccatgccgccttatcatgaatagaaggaatttctctatacatattaaataactcactttcatctaatcctaaactttcaataatatatgtataactatgggtatgtaatgcttcttcaaaagattgccttaaaatatattgacgacattctggattagtaatatttctatatacagataaaacaagattattagcaaccaatgaatcagcagtagaaaaaaaacctaaagctcttttaagaataattttttcatctttagttaatccataaggatttttccataaagctaaatcagaaaccatgctgatttcttgcggcatccagtgatttgcgcaactatctagatatttttgccaagcccaattatactttaatggaaatagttggttaagatctgcacgacagttaataatttttttatcatcaacttgaattctatctgcgcccattacaatttcttctaaacctgttttttgaaaattttttgtattatttttttttatattttgattaaaatttgacataattatttaccttctattgacatgtttcacaatcaaaatcttgaacagaacatgcttttggattatttgaagattctacagaatttaatgaattatctttttgtatggtaaatttttcagtattgcttgcggaaagagatcgaagataatatgtagttttaagtcctttaatccaagctaatttatataatttatcaagaatttttcctgaaggagttgataaatataaattgagagattgtgcttgatcaatccatttttgtcgacgagaagcacattcaattagccaagattgatcaatttgaaatgcggttaaatatattcgttttaaattagaaggtattcgtttaatttcttgaatgcttccattaaaatattttaaatcattaaccatattagtatcccaaattttatgtttttttaaatcttgaattaaatatggatttaatgatgtaaactctcctgataaatttgattttacaaataaattcttatatgtaggttcgatagattgagaaacacctacaatatttgaaatagtagctgtaggcgcaatagccatgatattagaatttctcataccgttttttttaatttttttacgaaccagattccaatctaatgtttgatttttattaattttagtataaaattttcctcgatttttttctaaattcttaattgaatcaattggcaatatccctttgttccataaagaacctttaaatgtttgatatgttccacgttctagagctaaatcagaagaagctgaaattgcaaaataactaattatttccatagaaatatctgaaaactcgattgcatattgactttcatacggaattcctttcatatataaaacatcttgaaaccccataatacctaaaccaattggtctatgttttaaattggaattttttgcttgtggcaccggataataattaatatcaattacattatctaacatacgaactgcagtatatattgttttttttagtttcaataaatcaatatctccattatgtgtaatatgttttactaaatttatactgcctaaattgcatacagcaatttcttcataagacgtatttaaagtaatttctgtacataaattagaactgtgtataactccacagtgttgctgtggagaacgtagattacaagaatctttaaaagttaaccatggatggcctgtttcaaataacattgctagcatttttctccataattttattgctttgatttttttaaagagaataatattaagatttttagccatattttcatattttatatatgctttttcgaaagcaataccatataaatcatgtaattcttgtacttcatttggactaaataaagtccaatatttatcttctaatacacgtttcataaataaatcaggaatccagttagctgtattcatatcatgtgttcgaagtctatcatctcctgaattttttcgtaattctaaaaattcttctatatcaatatgccatatttctaaatatgcacatacagctccttttctcttgccaccttgattgacagcaagagcaatatcattgctaatttttagaaagggaacaattccttgtgattttccatttgttcctttaatagaagaattcattcctcgaatataactccaatcatttccaattccacctgaaaatttttgtaaaagagcattatctctcattgaagaaaatatattaaataaatcatcagatatagtacttaaataacagctagataattgaggccgcaatgttccagaattaaataatgtaggagtagaagtcatataattaaaagaagataataaattataaaattctatagcacgatctgtaggattatcttcttttatagataatcccattgcaacacgcataaaaaatatttgtggtaattcataacgaatattattttcatgaataaaatatcgatcatatagtatttgtaaacttaaataagtaaattgtaaatcatttttatattttaaagaatatcccaattttttaagatcaaatttcaataaatccatactgagtctttctaattcaatgcctttgtgaataaataatataaatattttaggatataatttttgtatttcttgataatttttttctttgatttttaaaaatttaaacgtttctgtttgaagttcatcaaggagaagtcttgcagctatataagtataatttggttcagtttctattaaggtacgtgttgccattataaatgcttttcgaatttctttattgcttgctccattgaataaatttctttttgtttcttttaaaatagctttgtaattaagatcttttaattctgtacatgctttatagcaaatattttttaaacgataaaattctaaagaattttctttatttttatccaaaataacctctaatttataatcattttctttaaaatgtttctttcgtataatcctacgtttttctctatataaaacatatgctctaacaactttatattctcctttttgcattaaatatagttcaatttgatcttgtatatcttctatatgtataggatttttttttttggttaaaaatccatgtttttcctgaaaaaaattataaataattctttttaaacgactagatttattgcagtcttgtattccttcaactgcaaaaaacgctttttcaattgctgtttttactttattcttattataagaaacgatatttccatttcttttaataacttttatatttttcttaatttttatatcattcattttatttctttataaagaaaaagtgtttttttagatatttcaagaaaatatctattttatttaaaaagaaatttattaaaaatttctaatgatttgcataattattagagataaaattccaattaataatttgccaaaaagatttaatatattgcaaacgtacatttcgataatcaatatagtaagcatgttcccatatatcaattgtcattaatggtattttattatgcattataggtgtgtcagcattttttgtattaaaaatttctaattgattattttttgttttaactaaccatgtccatcctgatccaaagtttcccaatgcttgcatagaaaattcttctttaaatttattaaaagattcaaaattatcagaaattttttgtataaatttattattattaatgtaagattttttagatatatgaggttctgtcaaacaattccaataaaaattatgattccatacttgagctgcattattaaaaattgcatttttactagaaataataattttttctaaactttgattattataagatgtattatgaatcaatttatttaaattttctacatatgttttatgatgtttttcataatgaaaatttattgtttcagaagaaatataaggttctaaagaattttttttatatggtaaatgtaataatttaaatggcatgctataacgtccttttaatttataatattttaaatataatgtttaaatagtttaatatgttttttttataaataaaacaatctttattaaattataataatacgggataaattgcaaaatggaaagtatagaaaaaaaaattcaaaatcaaataaataaaaatccaatccttttatatatgaaaggaaatccagagtttcctcaatgtggattttctgcaaaagtagtaaaaatattacaaaattgtaaaaaacaatttcaatttattaatgttttagaagaacctgaaatacgtaaagtattaccaaaattttctaattggcctacatttccccaattatgggtaaatggaaatttaattgggggttgcgatataatttcagaaatgtttgatgaaggagaattacaaactttattagaaagtataagatcttaaatattctttaattttttaaagatatggtattacttttaataccatatctttaattaaaatttcctttattcaagagacaataaaaccgtgttacctccagtagctgtagtattaatactaatagtacgctcataagataatcttactaaataattaggaccaccagttttaggaccagttccagacaaaccttctcctccaaatggttgaactccaacttcggcaccgatttgatttctattaatataaatattaccaatatttaagttgtcacaaatatattttgctgtatcattcacacgagtatgaactcccgctgttaagccatatcccatattattaatttgattaataattttctttaaatcatatgaattaaatcgaataatatgtaaaataggtccaaaaatttcttccttcaaaagattaatgttattaatttcaattattgttggagggaaaaaatttccatttatatttgtattgttttttatatcaacctgataaatcatatcagcatatagtttaatataagatatataatctaataatttctttttcgattcttgatcaataatagggccaatatcagtggataaatattttggatcgccaatagttaattctttcatagcacctttaatcatagaaattaaattatcagcaatatcattttgtacaaataaaacgcgtaatgaagaacaacgttgtccagaattattaaaggcagaatagataatatctgttgttacttgttctaataaagcagaagaatctacaattaatgcattttgaccgccagtttctgcaattaaatttgtaattattccagattttttagaaattaatctaaaaattctttttgctgtatcatttgaacctgtgaaaataacactattaattctaacatcattaataattttttctccaataatatttccatctcctggcagacattgtactacatctttaggaattccagatttatataataattggacagttttatgagcaattaaacttgtttgttccgcaggttttgcaataactgtatttcctgcaacaatagaagctacaattcctcctaagaaaatagccaaaggaaaattccatggactaatacatgctataattcctcttccatgatagtataaagaatttttttctcctgttggtcctatcatttctattggagaagaaaaaagtttttttgcttcttctgcataatatctgcaaaaattaatagcttcacgaatttcggatatagcattaggaattgttttgccagcttctttaattaataaagctataaaattttccatattattttccaataaatttcccattttttgcaagtaatatatacgatctataactgatacttttttccatttactaaaagcaattaaagatctttctatagcaatatcaacttcattgggatccgtatatataatagtgccaataatttctttagaattttctggatttaacacatatttttcatatcgatttggtttatttatttttgcaattaaaggataagattcccatcttttagtagcaaaatttatttttttgattaattttttcattataatacgattattaatgtctattcctttagcattaattcgagttttataaatattttttggcaatggaatattaggatggggttctccatcaaatttttttgctataataataggattttctattaacttttcaggagagatttttttatctctaattcgataaataaaagaagtatttgctccattttctaataatcttcttacaagatatgctaaaagatgcttatgattaccaaatggtgcataaatccgacatggaattttattatttgattgaacaatttgatcatataatccactccccattccatgaaggcattgaaattcaaaatcaacaccatcagaaaattctaaaatagatgcaatagtatatgcattatgtgttgcaaattgagaaaaaatttcttttttataaaaaagcattttttttgcacaagctatataagatatatcagtataagattttctagtaaaaactggataattttcaaaaccacctgtttgagctattttgatttcactatcccaataagcgccttttactaatctaactatcaatcttttattgcttctatgtgaaaggtttattaaccaatctattacagaataagctcttttttgatagctttgaacagccaatcctaatccattccaatttataagatctttgtctaaagctaatttttctataatttgtaaagaaatctccaattggcttgcttcttcagcatcaatggttaatgttatattatattttttagatctcatagctagatgttttacacgactatataattctttcattacacgttgcaactgggaaaattcataacgagaaaacaaagctgataatttaattgaaatattaggtttttgataaatatcattaatatttttagagttttttccaacaatatcaattgtatttaaataattttgataatataattcagagtctttctctgtttttgctgattcgcctaacatatcataagagtaatagtatccttttgatttttcttcttgagatttttctaaagattcttggatatcttctcctaatacaaattgtctactaagaattttcatagcttgtctaataataagacgaattgatcctttactagttcgtattaaaaaatttttaaatattccagataaattttttttatatgatggctttataatttttcctgtaatcaataaaccccaagttgcagcattaatgaaaatagaatcgctttgatttatatgatttttccagtttgctttacaaattttatcttttataaatctatcagatgtttctttatctggtatccttaataaggcttccgccaaacacattaatgctattccttcttcattagataaattatattctgtaagaaatatatctatatttcctattttttttttgttatttctagcatgaataatcaattgtttagcataatttgtaatttttttatttatattttcttcaaactctgcatgagaaattaaatttaatatacattgtttttcatctaaataatgagaatcagaaatttttttttctaatatagtttctgatttaagaagaaaatccttaaacaacatttagttgatccttacataaatattttaatatgttacaatatcatgaaaacaaacatgaataaaaaatattttatataattaaattataaaaagtaaatgtattatttttgcattgtaaataaatataattttgtataaaaaaatattttataataactattttatttacttaaaattaaaaattttatttaaaatttttattgaaaaataattgaataaaaatgccaaaaaaaattagaattaaacatcatataaaaatgggacgtcgtaaaggaatatttttgctgcctaatatatttacaacaataagtttattttttggttttttttctattatttacagcataggattacaattttttatatcatctatttctatattaatagcatttatttttgatagtttagatggaagagttgcaaggataataaaagtacaaagtgattttggtgcagaatatgatagtttatctgatatgattgcatttggattagctccatctttaatggtttacaatttttctatacaaattttagaaaatatagattggaaaagattttcttggttatcttcttttatatatattgcttgtgttgctttgcgattagctaaatttaatactcgaattaaattaaactctgcactagctaaacgatatttttttggtatgccttgtcctgcttcagcaatttttctatctagtatgatttggttatgcaatttttataattttaataattatttaattttttttctttctgaaattttaataattatttttggattattaatggttagtaatattcgttatcgtagttataaagatatagatattcgatctccagtaaaatcaaaaatattagttgcaattattctaatcattggtttaatagcttttcaaccaatatggaccgtatttatattatctggtttatatattacttcaggaccaatatataaaataaaattttttttacaacaaaaaaaaaaaaaataatttagaaaaaatttaatgaaaaataaaaaacatatatggaatacatcacaaaaaaaaattctgaaatctctaaatttagattatttaatttttcaaaatcatattgataagcaatatataaaaaaaataaaaatcaattacaatatattagaagaacttcataattatgatataatattagcaactcaaaatattactatagatagtgatatatattatttgctcaataatattaaatactttttaagtctttataaatttacgatttgtatcgtaaaacaagttaatgaaacttcaaaaaatttttttacaatcaataaaattgtaaaaaaaatcaatcctaaatggattatatgttttggcaaaaaaatatatgaagattttttagaaaaaatagataaaaaatttttaataaaaactttagaattaaaagaattattaattgatcctttaaaaaaaaaacaggtattttgggatgttaggcacattacaatacagaaaatctataatagaagatttatcaaaaataatgaaaattaaatgttaatttcatatatttcattaataatgaagcacttatttttaagtgaaagtttttataaaaagattataacaaatgtaaaaaatattattagatattatttatatatatcttaaatatttataggaatcaaaaaatcatttttataaaaataagatcctttgttttaaagataaaaaattgaaaagagtttaaagcaatctaattaagatattctgaaaaaatgtatattaaaaaatatttttgttaaaattatattttctaataattctactattattttttataaaatttttaatttgaataaagatataaaggaatattttcatttttatttttagatattattctaaataatattatcaaataaatttaagttcaacttaatattacatagattattttaatgatcactgataatatatttaattttttgaattaaaaatctgaagtgataaatgaaataaaaaaaagaaaaacttttgctattatttctcatcctgatgctggaaaaacaacaataacagaaaaaattttattatttggaggtgcaattcaattagcaggaagtattaaagcaagaaaatctcaaaaaactacaacatctgattggatggaaatagaaaaaaatagaggaatttcaataacaacatcagtaatgcaatttccttttaaagagaaaattattaatttattggatacaccgggtcatgaagatttttcagaagatacatatcgtacattaagtgctgtagattctgcattaatgattattgacgctgctaagggtgtagaaaacagaactattaaattaatgaaagtttgtcgaatgaaaaatataccaattataacctttattaataaatttgataaaaatagtaaaaatccaattgaattattagatgaaattgaaaaatttttaaatattcaatgttttcctgttatttggcctataggaatgggtagagaatttaaaggaatataccatatattaaaagataaaactattttatttaaatctggatataaaaattatatatactattttcaatctatatatggaattaataatacagaatttaaaaaaatatttaatttttttgatcttttagaagaagaaatcattttaattaaaaaattatatacattttctaaatcaaaatttttatcaggtatgataacaccaatatattttggaagtgctttatgcaactttggtattaaagaattactagaagattttattaaaatatctccttctcctatgtataggaatgcttataccagaaaagtttatccagaagaaaaaaattttagtggttttatttttaaaatacaagctaatatgaatccgaaacatcatgatcgtattgcttttttgcgtatttgttctggaacatataaaaagggtatgaaaattaaacatgtaagaactggaaagtatattaacatttctaatgcattaacttttatggcaaaaaaacgtataaataacgaatattcttatgcaggagatattataggaatccataatcatggaacaattaaaattggagatacttttaccgaacaagaagatctaaagtttacgggaataccaaatttttcccctgaaatatttcgtcgtattattttgaaaaatccattaaaaattaaatctcttaacaaaggtttgttacaattatctgaagaaggagcaatacaagtttttagaccaattataaacaatcatattataattggagctattggaacattacaattcgatgtagtaattcaacgattaaaagatgaatataaaataaaatgtgtgtacaaaaatatatctattactcatgctagatggataaaatgtattgattccaaatatttggaatattttaaaaaaaaatatttatcttatttatcttatgattctggcaattatctaacttatttagctccgagcttcactaatttaaaattaattcaagaacgatatcctaatatattattttctaatgttagagaaaattaactatctaagaatataaattttaatttaaaaaatattaatttataatatgttttatatacaaccttctaaaatttaagagaaaaaattatgagaataattttattaggtcctccagggtcagggaagggaacccaagctaaaaatctttctcaatctttaaaaattcctataatttcagtaggcgatatattacgaatatctcaaaacaaaaaaactattccaatttatgaattaaataatgcaatattacatggaaagttaatatctgattctattattataaaattagttcgcatgtatattcaaaaatccaaatatcaaaaaggatttatattagatggatttcctagaactttagaacaagctaaagcaacaaaaaattttaatattgattatgttatatcattaatagtagataacaaaactattattaatcgaatatcaggaagacgaattcatcttccgtctggacggatttaccatatttttaataaccctccaaaaaatttaaatagggatgatattacaggagaattattaactcaacgtcaagatgacaatgaaaaaattataaaaaatcgattattaatttataaaaaaaaaacccaacctttaattttttattatacgaataaaaatataaaaaataaaaatccaaaatatattgaaatttcaggaattggccttgaaaaatctattactgctaatattttaaaaaatatttatacacataaaaaatattaatattattatggtatgtaatattaaaaacctaatatttaggtaatataaaaaaatatatattttaagtatatcaataacaataaatatcatattataaaatataaaaaaataaattgaatattttgaaataatgcatttatataaagttcgaaatttaatttttcaagacattgaaaaattggataagtggatgaaattttttttaaaaaattccataccattaattaatgatgtttgtcattataccatttataatggagggaaaaaaattagatctattttatgtctattatcagcaaaaagtattttttgcaattctaatgtagctattatattagctatgattatagaaattgttcatacagctactttattgcatgatgatgtaatagattcttctaaaatacgaagaggaaaaaaaaccgtcaatacactatggaataatacaacagctattttaagtggagattatctatattccaaagctttattactaatgtctaatttagatgataaaattgcaatgaaaaaattaatacaatgtactcaaaaattagcagaaggagaaattatgcaaatgtatgctaattttaacattaatattgaagaaaaagaatatttaaaaattattaattataaaacagctattttatttgagatggcttgtagtttgccagctattattttaaaaaaaaattttcaaacaattcaaatatttaaattattgggacatcatattggaatggcatttcaattaattaatgatattattgattataaaaatataaatgatagaattagaaaaaaatcttatgaagatttatatgaaggaaaaatgacattgccaattatacacataatgcaaaaaagaaataatataaaaaatatagaaaagatttatcaagtttttgataaatcattaaaaaatagaaaaaatctttttcaagatattcataacttagtaattaatagcggttctattgagtatgttaaaaattgtatacaaaatgaaattaatttagctaaattatatataaaaaaattaccatattcttcatataaaaaaggtctttttatgatttgtgattctcttattaaaaagggtatcaaaaattaaagttcttttaataattttataaaataaggtttagaattaaaatgtcaaagattgttgttgtcacctctggaaaaggaggagttgggaaaacgacaactagtgcagcttttggcactgcattatctattaatggatatagaaccgtaataattgattttgatgttggattacggaatttagatttaattatgggttgcgaaagacgtgtaatatttgactttgttaatgtaatcaatgaagatgtacatttgaatcaagcgttaattaaagataaatatactgataaattatatattttaccagcatctcaaacacgcgataaagaagcgcttcatattcaaggtgttggtaaagttttagaggaattaagccaaaattttgattatataatatgtgattctcccgcaggtattgaacgaggggcttttcttgctatgtattatgcagatgaagctattgttgttgcaaaccctgaggtttcttcagttagagattctgatcgtatgttaggtttattatctagtaaatcccaaaaatctaagaatcaaaaaaataaaatgaaagaacatttaatattaactagatattctcctaaaagagtaaaaaaaggagacatgttaagcataaaagatgttcaagaaattttaaatatatctttaattggagttattccagaatccacagatatactcaaagcttctaatttaggaaaaccaataactttaaacaaaaaaagttatgcaggtcaagcttatttagatgcagcagatagatttttaggtataaaaaaaccatatcgttttattaaaagtgaaaatttttttaccagattattaagaaggaaaatttttagatgaaattactaaatctaattttctcttatttaaaaaacaatacaaagaatatttctactgcaaatattgccaaagaacgtctaaaaataattttttctcatgaaaaatcaaaaaaaaataattcggattttttaataaaaatgcaaaaagaaattatgcaagttatttttaaatatactaaagttcaatctgatcaaataaaaattgattttggtaaaaaaggagactgttctattttagagttaaatattattgtacctgaaaatatagaaaattcttttaaagaaactaaaaaattaatttaattttatgaaaaaatataatttaaaaaaaaatacaacagatatttatgaattagttatttatcaattaaatccaataaaaaaaagaaaagaatggaaaattattcataaaaatcttacagataaattatttttaattcctggatgtctaagaatagatacatataaactattaagtagtaataatatcttttgcgattatgtatattgggatagcattaaaaatgcatacataggaaaaaaaaaatttaaatccttcataggatttgataaaatgatgttttatataaaaaaaatactttttagtggaattttttataaaagtaatgattaaatgtcaacatatataataggtgatatacatggatgttttaaaacatttaaaattttattaaaaaaaataaattttaatcctaatcaagatattttgtggttattaggtgatttagtgaatcgtggtccatattctctagaaattatgtgttggatattaaatcatcaaaataatatacaagcagttttaggcaatcatgatatttatgctattgcatgttattttcatagaaaaaataaaaaaaataatgatacaatagatgatcttttagatagtcccaaaataaatgatattatttactggatgcgtcaacaacctgtaatattttttgataaaaaaatacactctttaatagtccatgcaggatttaatcctaattggagtttagatcaaatttttttatatgcaaattatatagaaatgatattaaaaagtgatttaatatttgattatacaagagaatttcataatatccaaaaaaaaaaattaaatggttatttaaatccatatgaaaaatggtatttttatcttaattattttactaaaattagaatatgcaataaatttggaacgttaaatttaagattcaacgggaatcttaaaaatattccaaaaaaatttcttccatggttttgctataattttgttaatattaatagaaaaattaaaatatattttggacattgggctgctttagaaggcgtaaccaatgttcgtaatatttataatttagatcatggatgtgtatggggcgggaaattaacagctttttgtgtagaaaaaaaaacatatatatcagttcaatctgttgaatttaaaaagaaataatgtatatgttaattaatttaaaattaaagatatttcttttttattaaataaatttgtaatctctttgtttctttcttttttagaatattccaattattcataatatacttttttagtttagttgtttttttgcattcaatataaattaatccatgaggtttcagattattatatatatttattaaatataaacattgaaaaattaatttggtataaaatggaggatctaaaaagataatatcaaatttttgatttttatataatttaagccatatttctgttttaatatgatataggcgaacagaggatggacttataggaaattgtaaaatattttttttaagatgctgaaaaatttctttattatattcaataaatgtaacgtgttttgcatttctagacaatgattccaaaccgagagatccagatccagaaaaggcatctaaacaatatgaattaataatattatttttcaaccaattaaaaagtatttcttttaatctaccaagggtaggacgaatattttttttttaggaaatttcaatattttacctttccatttacctccaattatacgaatagatgaattattcataatttatcaaaaaaaaaattaaaaattttaaaaaacattattaaatgcaccatatatatttatccgaatattatttggaataatacttgcgattttagcagtttcaatataaaatcacaagaaatataactttttagaaattcaatttcttctatatttttatacatttaattttagaagaggcggagtattttatatggctttgaatgttgaaaaaaaatctagtattattaaagaatatcaattaaaggataaagatactggttctactggagtacaaatagcaatattaactgctcgcattaaagatatatcatctcatttaaataaacataaacaagacaaacactctcgtcatggtctattaaaaattgttagtaaaagacgaaaattaataaaatatctcaaaaagatatctaaataatagcaaaattatattcaaattatagagaatatatattaattaaatatttttaatattttttaataaatatattattgctattttaataaggaaaattttaaatgaaaataattaaacaaatatttgaatttggagatgataaatatattttagaaactggaggaatagcaagaaaagcaacatcttctgttattgttcgtgtaaaagaaacagttattttagttactttagtagcaaaaaaagaaatatcttcagatataaatttttttcccttaaatgtgtattatcaggaaaaaatgtatgctggagggatcatacctggaggatttttaaaaagagaaggaagacctactgatcatgaaattttgatttctaggctcatagatagacctatacgaccattatttcccaaagatttttttcatgaaatacaaattgtagcaacagttctttcatcagatccaaaaattattagcgatattcctgctatgattggtgcttctgctgtatgttcactttctggggttccttttttaggtcctattggatgtgcaagaataggctatataaataaaaaatatgtattaaatcctaattataaggaattagaagattcttcattaaatttaattgtttctggaaataaagattctatattaatgacagaagcagaatcaaatcaattatctgaagaaattattttagaatctataatgcatggtcatgaacaattacaagtagttatacaagctattaatgaattagtagaagtttgtggaaatcctaagtggaattggaatccaaatcttgtagatacaaaattagtaaaaaaaattaaaaatatagtaaaatctcatattcttgatctttaccagatatacgaaaaaaataaaagaaatattcaaattacagaaataaaaaatcaattttatcaagagtatctaaaaaatatcgaaatagaaggaaaagaaaaaaaaatctctgaattaacaataatgaatatatttaatcaaatagaatctaaatatattcgcaaaaaaattttaaatggtggacttagaatagatgggcgtaaaaataaaactattagaagtatacatatagaaaatggtattctaccgcgtgtgcatggatcatccattttctcccgtggagaaacacaagccattgtggcaactacattaggacatgaaagaaatgcacaaataattgatgcaatggttggtgaaagcaaaaatagatttttattacattataattttcctccttattgtgttggggaagtgggaataattggtgttccgaaaagaagagaaattggacatgctaatatagctaaaagagcttttaaatttgtttttcctaatgaaaaagaatttccatatgtaattcgtgttgtttcagaaattactgaatctgatgggtctagttctatggctactgtatgtggtgccagtttatcaatgatgaatgcaggaattcctattaaatcacatgttgcaggaattgccatgggattaataaaacaagacaataaattcgcaatattaagtgatatcttaggtgaagaagattatataggcgatatggactttaaagtggcaggcacagagcttggaattactgcacttcaaatggatataaaaattccggaaggaataaacaaaaatattatttattctgcattagttcaagctaaagaaggacgtattcatattttgaaattaatgaatcaagtaataaaaaaatctataaatctttcaagatatgctcctcgtatttataaaatgaaagtctcaacagaaaaggtaagagaaataattggaaagggaggttcaacagttcgttctattacagaggaaacaggagctaatattgatattaatgatgtaggtattgtaaatatattttcatttaataaaataggagcggaaaaagctataaatcgtatcaaagaaattttaatggaaccaaaaattgggaaagagtatgaaggtaaaatctcaagagttgaagattttggagtatttgttactatcttgccaggaaaagatggattattacatatttcaaaaatacaagattataatatagattataaatcatacttccttataggaaaaaaaatatttgttagaatatcatccattgataaaaaaggaagaattaaattaacaatgaataaaaaagaaataaaaaggaaaaagaaaaaattagaaaagaagaaaatttaaaattataattttacagataaaaatatttattaatttcaatcatttctcggaaagaatataagataagatcataaagatcttatcttataaaagaacaatatctatactatattatagtatatatctgcagaaataacatgcatattaccatgtgcttgcatatttcctgtttcaggaatttgataataagtgtatccaattctagtgcttattccatcattccaatctatatttataccagcaccagcattaaatcctgcttgttttactgatttaggatttgttccgcttgatacaggaaaactatagtttgaaaaattaatcccataacctgctttagcatatatattaaaatttgaataattaaacatttctaaataagaattattagtagaattactactaataggtacagatacaataccatcaatactaccgttataaaacgttgcagaatttctaaaagttttgtctcgatcattattataattttgaaatgcaccaatacgttctgcacgtacttcaattttcaaaaaattatttaattttaatcctgcaaaaattccaacaggaatatgattttcaacaaaattttctattttaccatcacgacttatgaatttactataacctacacttatacctaaatatttattttcttgattatttttatgtagaaaagtttttggaaaaatctcttggtttttttcagatttttctgcaagattctgatcttcattatattttgtattttcatgaataggattcgcatacacagatgcacttcctatccacaatgcacttgaaatcatagtagcgaaaattgattttttatggttccatgccattaaattaactcctaaaatttattattggtaatagactaaaatctttattgtttatacaatattttttttgaataaaaaattaaatataacaccttgagtagaataataacatatatattttaaaatatgcaagagaagatctaatattaaaaactttatatattaaaatatttatgtttgatacgtttccttagaaaggaatatacatattattcctaataataaaaatacaggcaaaattgataaagcaattttataatcgtggattaaaaaaattcgtgtatgattattgataatatgattccaacttaaatctaaaagctttccaatcattgaccctgatatggcaccacataatgcattaaacatattaataaaaccaattgaagtagcagataaatatataggattgctttctttaatcatagtgaaagaaactaaaaaaaaaccattaaaaaatcctaaaaaaaataaacaaaaaatcaatacccaaataggcaaaaacatatagattattaaagataaaaatataaaactcatactagttcccacaatcataatattctttctattttgaaaataatctgataaccatcctcctaatggagcgcttattaaaaatcctataaaaattatagaattaaggcttgcaatatatacacgatttatatgatatacatgcattaaatatgggatgctccaaaatcctccaaaaactgatataggaacaaatgcaaatcctgaatagcaggatatcaaccatgattctttattaagaagaatttttataaatccttttacaatataactattagattgttcttttgataataatttttttttttgaaaattctctttaataattaaaataaataatacaaaaataattaatcctattaatgataaaaaaaaagaactttttctccatccataaatttttatcatataggataatggcccttctgctgttatcgcccctaccataccaaatgccatcataattcctgatattaaagcaaatttattttttgaaaaccatatactaattaatttcatagttccaaccacagcacttgaacctccaagacctatcaataatcttcctacttctatataaaataatgaatatgctttcgaaaagataaacatgcctattgtacaaattaatattgatatagtcattatccatttaggactataacgatcaattaacaaacctgcaggtatttgcataattaaatatatataaaaataaatacctataatatttcctaaattaaatcctgacaaatgcaaatcatgaagcaattcattagtcataacagtcggagatatttgtaataaatatttatataaaaagaaactagaagaaataaaaaacactagccaggaataaaaactatttatattttttttaatttttttttccattttaactctaaatatattttttttttattatgaactaaaaaaataaatattcatgaaatttttaaaaatttttatattttatgttagaataaaaaaattttatatctaaattctttaaaaatctaatgtttcaaacattatcaaataaaattttgcatatttttaataaaattagaggatatggacgtttatctgaaagtgatattaataaaacaataaaaaatatacgaatagcattcttggaagcagatgtttcattagaagtaataaatcattttatttataaatttaaaaaacgtgctatgggatctgaagtagggagaagcctctctcctagtcaaactatcataaaaattgttaaacaagaattagtttctattatgcaaaagaaaaatttagatagcaaaataaaccttaatacacaaccaccagcggtcattgtattagcaggattacaaggttccgggaaaaccactagtgttataaaaattgcgaaattatacaaatttttttataaaaaaaaagtattagttgctagtatagatatatatcgtcctgcagccatttctcaattatgtatcttgtcaaaagatgcagaagttgactttttttatcatcatgaaagcataaaaaatgatcctataaaaattgcaaaatctgcacttgtttattctaaaaaaaaattttttgatatattaattgtcgatacagcaggtcgttcacatataaatataaatatgatgaaagaaatgattttattaaaaaaaaatcttaatcctattgagatattattaacaattgattgtatgatgggtcaagatgcaattaatattgcaaaatcatttgatgattatttaaaaatcactggtttttttttaacaaagtctgatagtgatgcaaaaggaggttcagctttatctattcaatatattactggaaaacctattaaatttataggtacaggagaaaaaaattctgatatagaaaagtttgaaccagaaaaaattgctaatagtatattagggatgaacgatattttaaaaaatattaaagatatagaagctaaattttatgattccaataatattaaaataaaaaaaatagaaaacaaaaaaaaatttgatttaattgattttaatcatcagttaaaaatgttaaataaaataggaaatatagatacattaaccaaaaatgtttctcaattaagaaatttttctatatcaaataaaaaaattatagataataatttaataaaaaagatgcaatttatgattgactcgatgactgtaaaagaaaaaaaaaatcctaatattattaaatcttctagaaaaaaaagaattacatccggatctggcactaccatacaagatatcaataaaatgttaaaatattttatagttataaaaaaaaatcttaaaaaatatggtaagaaaaaaaaaaattttaattttcttaacaactaggataaaattttataaaaaatctttatttaatataaaaaaattagtattatttataataaatatttttaaatcagtaaagtaaatatatttatggtagtcattcgtttagcaagaagaggatctaaaaatcgtcctttttatcaaatagtagtcacagataagcgcgcacctcgcgatggtcgttttatagaaatagtaggatttctaaatcctttattattaaaagaaaataaaaattatatgtttttaaatattaaatctattaataaatggattaaaaacggtgctcaactatctgatactgttgaaagattatttaataaaattaaaaaaaaatctataaaaagaaattcaataaattaatttttttttttaacaaaatcttttgtaacaataatacaggcaagcctattaaagaatttggatctttcccaagaattttatttactaataatatacctcttccttcagatttaaaacttcctgcacatttatatggtttttcttgttttaaatataattcaatttctttgatagaaaattttcgaaaaaaaacttccgttttttctatagaagttttcatataattttcagtatttataaaaacacaaataccacaataaaatttcacacattttcctcgaattttttttaattgaatgaaagcttgattgtaggaataaggttttcctattatttctttatcaattattgccatttgatcacatcctaaaattataaatggtttgttttttggaatcatagaagaaactgcgattactttttctttagaaagtctttgaactaaattagaaattttttccattggaaatggtttttcattaatatttggagaaatagaaataaatggaatgcccaaatgatttaaaattttctttcttggagaagaagaagatgccaaaactaattttagtgtattcaaaatattatttttttataatcttaattattaataaattatataaataatacaaataaatatacataattattgatatataattatattattttttagttttaaaaaattaattttcaaaattaaatacataatatttattgaatattttttttaaaataattaattaaattattaaattctatatctataatttttccagtttttctaaatttatattctacttttttattttgtattttcttttcgttaagaacaatacaatgaggtattccaatcaaatcaatatcttttaacataacaattgtctgttctcttctattatctaataatacatcgaaaccaaaagaaataagattcttataaagaatatttgcataattataaactattttagattcataatattttataggaatgatagctatataaaaaggcgctattttttctggccatataataccatttttatcatgattattttcaataatagcacatatagttcttgaaattcctaatccataacaccccatgaatggataaataaagtttccttgttgatttaaaatagataaatttaaattttttgtgtatttttctcctaattgaaatatatgtccaacttcgatactatttgaatagttaaatatatttttattatttatagaattttttttgaaattttggatatctttagatataagattattttttttatcagatatataattaatatcaactttcgtattatctgtaaatgcgtgaaattcttgattaatttcaccaccaataataccggaatcagcattaattattttaataaataaacctaattttttaaatatttgataatataaatcccgcatatttttgtatgttttttgtaaacaatatttatttaaatgaaaagaataagaatctttcattaaaaattctcttgatcgtattaaaccaaaacaaggtcgcatttcatctctaaattttgtttgaatttgataaaaatgaattggaagttccttataacttttaatagaatattttgctaaatctgtaataacttcttcatgtgttggaccaaaacaaaaattatgtcctttcctatcttttatttttagtagttcattgccaaatttttcccatcttttcgtttttttccaaagataagctggaataatacaaggcataattacttctagagctccaaaaaaatccatttctttctgtataagattttttattttttttaatacttttacccctgtaggcaaccaactatataaaccacttgctaatttttgtatcatgccagaacggatcattaattgatgactaattatttttgtatctttaggtatttcttttttagtatttaataaatatttttttgttttcataaatttaaaataatgttagcaaaaaatttattatataatattattaattagaaattatattatatttaactataatatatatattattttattttttgataaaaaatatttatattatcttaaataaatatattaatttttttctatatttaagatatcttatttaagataataatatgatttaagttaataatatgataattatttaataagaactatgattaactatttttttaaaacagagaaattatatgcgtaaatattgtacaaatataacagaattatatataggaaaaaaaatagaactacaaggatgggtacataaaatacgaaatcatggaggtttaatttttatagatttacgagatatttcaggattaatacaaattatattccaacctgaaaataaacaaatatttcaaaaagttttaaaattaaaaaatgaatacataattaaaattattggtttagtcaaaaaaagaccagtaaaaaaagaaaatataaaatcttttacaggaaaattagagataattgcttcaaaattagttatattagcaaaatcttttcccttgccatttccagtaaataaatatcaagatttaaatgaagatattagatttacatatcgatatattgatttgcgtcgttttgaatctcaaaaatacatattgttacgaagtaaagtaacaaatattttgcgttcttttttagaaaaaaaaaaatttattgatattgaaacaccgatacttacaaaaagttctccagaaggagcaagggattatatagttcctagtagaatacataaaaaatgttattttgctttacctcaatctcctcaattatttaaacaattacttatgatttcaggttttgataaatattatcaaattgcaaaatgttttagagatgaagatttacgtgcaaatcgacaaccagaattcactcaattagatattgaaatgtcttttattcaagagaaagatattattaatttttctgaaaaattgattaaatttgtatttaaaaaagttatggatattgattttaaagataaatttccttgtatttcttataaagaatcgcttctaaaatatggtactgataaaccagatatacgtataccattggtatttcatgaaattaaagaattgtttcaatatgaaaatcatagatatattaaaaaatattttcgagataaaaattcacgtattgtagctttaaaaataccaaatggtaataagattatatctagaaaagtatttaaattttacaaaaattttgtattagaaaagggatcagaaaatttatcttatataaaagtccttagcataaaaaaatctagtgaatttaatattaaatcttctcttgataagattatatccaatactactataaaaaatatattgcaaaaaataaaaactaaagttaatgattttatatttttaattgcagataaggaagatatagttaatacatgttttaatgctttaagaagaaaaataggtaaagattttaacctttattcatcccaatgggcaccaatttggataattaatttcccaatgtttaaaaaaaataaaataaatttagaatctgttcatcatccctttacttctcctagtattgataatattgaagatcttaataagattcctttagaaaaaattttatcacgttcttatgatattgtaattaatggttctgaaattggaagtggatcaataagaattaattgtcctaatatgcaaaaagctgtttttcatttattaggtatgaataataaggaaatagaacaaaattttggtttttttattaatgcactaaagtttggagctccaccacatggtggcataggaattggactagatcgttttataatgttattaagtaaaacaaataacatacgagatgtaattccttttccaaaaacccaaaattcatcttgctttcttacaaaagcaccttcatttatttcaaaaaaccatttaaatgaattatcaattttctataaaaaataaaatttaaaataaaaaaaccagagaataaaagtttatgtcaggacatagcaaatggtcaaatattaaatataaaaaatctaaagaagataatcgaaaaagtcgtatttttaatcgattaattcgagaaatatatatagcagggcaagatcagaaaaaagaaaactctaaaaatattgctaattttaaattaaaaaaagccatccaaaatgcttatgcagcaaatatgcctaaaaatactattgatcgagctataaaaaaaataaatgaaaaaaatttacaaaaatttgaaaatattcgatatgaaggatatgtattatttggtgtagcctgtataatagatacgattactaataatcggaatagaacagtttcaaaaattcgagaaatttttaaaaaatacggaggaaatttaggaagatctggttctgtatcatatttatttttagaaaagggtatattatcttttcatacaaaaaataacgaagatcgtattttagaaatagcaataaaagttaaagctgaagatattaacattaaaaaaaatggttttattgatattattaccactccaaataagcttatttctatattgaaaaaaataaaaatagaaaaaatttatccttataaaaataaaattatacctgtagctatatcaaagataatgttagataaaaataaaaataaggaattttctttgtttatgaatgatttaaaaaatattgaagatgtacaaaatatttatacaaatgctaaaataatataaaaattttggcggaaagagagagattcgaactctcgatgaattattttcatactcccttagcaggggagcgccttaaaccactcggccatctttccaagattttcattaaattaaaattatatttatattgatatgttatatgtcaaatactattatatcaattaatttacaaaaaatttttaattataattcatttgagatatattgcatctacaaagaaaattataactttattaataataatatatttatataacatatgtttcaaaattttcaaaaaaaatccaaaataaatatatatacagaatataagaaaagattatcaatttttagccttaaaaaattagataatcttttagatggtaaaattcaaaaacttccttattctattcgtgtattgattataaatttattacgaaatattggaaattataatatttctgaaaatgatttaattaatactattaattggaaagctaagagttatataagaaaagatattccttatatgccaaatcgtattataatgcaagattttactggtattccagctgttgttgatttagcagctatgcgagatgtattgtataaatacggtggaaatcctaaagatataaaccctattattaatacaacattagttattgatcattcaatacaagtagattattacaatacatcaaaagcattagaaaaaaatataaatcttgagtttaaaagaaatcatgaacgttattcattattaaaatgggggcaaaaaaatttagataattttaaagtcgtaccacctggaatgggtataatacatcaaataaatttagaatatttaaccaaaataatagaaataaaaaaaatcaattctgaattttttgcctatccagatactttaataggcacagattctcataccactatgattaatagtcttggagttattggttggggtgtaggaggcattgaagcagaagctgcaatgttaggacagccttgttatattaatttaccagatgttattggagttaaaatattaggcaaggcaaaagaaaatattacttctgcagatttagcacttaatataactgaaattttaagaaaatacaatgttgttggtaaatttatagaattctttggtaatgatttatctcatattagcttatctgatagagctactatttctaatatggctcctgaatatggagctactatagcttttttcccagtagatatagaaactatcaattttcttatagaatctaatcgtggtaaatatataaaaataataaaaaaagttttacaagaatctttattgtttagattaaatgatatttatcatccagaatattccgatattattgaaatagatatatctaaaattaatgctagtatttcaggccctaaaagaccacaagatagaatttctataaagaaattaaaaaattcttttaaaaaaagtcttattgcattaaaagatgaaaatggatttgaaataaataaaaatgatttagataaaaatgtatttgtaccagaaataaatgattttattgctcatggaacaatagtaattgctgctattacgtcttgtactaatacttctaacccttattctatgataggagcaggccttattgcaaaaaatgcagtaaaaaggggattaaaaataaaatcttttattaaaactagtttggctccaggttctaaagtcgttaccgaatatttagaatcgtctggtttattaaaatatatgaatatattaggatttaatatagttggatatggatgtacaacttgtataggaaatagtggccccttgtttaaacctattatagatgtttctataaaaaataatttagtattatgttctgttttaagtggaaatagaaattttgaaggtcgaattaatttatatgtaaaagctaattatttaacatcacctttatatgttatagcttatgctatagcaggaactataaatattgatttaaatttagatcctttaggaagggatatgcaagggaaaatggtctatttaaaagatatttttccaaaagaaattgaaataaaaaaaattataaaaaaatttattaattctaatatttttaaaaatcaatacgataaaatattttctggtacagaaaattggaaatctcttaaataccctaagggggatagatatatttggaacaaaaaatcttcatatattcgttctcctaattttttttctatgtccttaaataaaacatctcaagatattattaatgcacgtgttttactacttttaggagatagcgttactactgatcatatttcaccagctggtgcaataccatcgcaatatccttctggaagatatttgaaaaatttgaatattcccgaaaatgaatttaattcatatggttctcgaagaggaaatcacgaagtcatggtacgaggaactttttctaacatacgtttacaaaatttattaataccaaaaatagaaggaggattcacaaaacactatccttcagaaaaaattatgtatgtttttgatgctgcaatgtcttataaaaaagataatattcctttaattataatttccggtaaagaatatggcgttggttcttcacgtgattgggcagctaaaggaacaagtttgttagggattcgagctattattgcagaaagttatgaaagaatacatagaaataatttggtaggaatgggtattttgcctttacaatttatgaaaggtgaaggaagaaaatatttagatttaaatggttcagaaatttttaatatttacggattatcttctatatttcctttgaaaaaaatacaaattcaatattattatgcccataaaaaaaaaaaaatatattcattttatgcatttataagactagatacaaacatagaaattcaatatttttatagtggcggaattcttccgtatattttaaaaaataatttaaaaaaaaatcagaattaaaaaaaaataagattggctccccgagcagggatcgaacctgcgacccaatgattaacagtcatttgctctgccagctgagctatcggggatatatatagaaataattaaataaattttaagaaaattttaaaaagataaaaaccatatgtcaaattatttacaaaatatttttttaaaagattacttaaaaaaaataaattaacaaataatatatattcatataaagtttcattgtagaatatatttctaatttttataatttaattattatgaaaaaatccattaaagaaagactaaaaattttaatagaacgttatgaagaactatgtcatcttttaagtgatattaaaattattaataaaaaaaatatgtttcgaaaatattcaaaagaatattcaagattagaaccaatagttatgtgtttcaatgattattgtaaagaagaatcttacttagattctttaaaagaaatcttaaaagataaagatccagaaattcgaaaaatggcaaaacaagaatttcaagatgtttatagaaaaatccaaaataatttaaaaaaaatagaaatatttttattgcctcaaaaagaaaattatcaaaaaaatattttcttagaaattcgtgcaggaactggaggaaaggaatcttgtatttttgcaggagatttatttcgtatgtatagaaaatattctgaaaaccacaattggaaattaattattattaatcaaaatttcggagaacatggaggttataaagaaattatagctaaaatttatggagaaaatgtctatacaaatttacaatttgaatctggaatacatagagtacaacgtataccacttactgaatctcaaggacgtattcatacgtcagcatgtactgtagcaattttaaaagaagttccaaaatcagaagagattaaatttacaaataatgatttaagaattgatacatttagatcttcaggagcaggaggacaacatgtgaataaaactgattcagcaatacgaattacacatttacaaacaggtatagtggtggaatgtcaagacgaacgttctcaacataaaaataaagcacgtgcaatgtctttattaaaagcaaaaatatttgatcaagaaaaaaaaataaaagaagcaaaacatgcaaaaataaggaaaaaacttataggaggaggagatagatcagaaagaattcgtacatataattttccccaaagccgaataacagatcatagaattaatttaactctttataaattggaagatattatgtctggaaatctttctcttttaataaaaccaatattaaaagaatataaatctattttgttatcaaaaaaataaattttaagaaacttttatatttgaattaatttcttgcattgcttgatatattttcccttctaatattagatggatatattgtaaaaaaaaaataatagcttcattgattttattttttttttctgtacaaactttttgcaaaacatatttttgtactttttttttatatcctggatgcccaatgccaatacgaattctccaaaaatttgatcctatataagaaataatattacgtaatccattatgccccccgttacctccactatactttaattttatttttccacatggaaaatctaaatcatcatgaccaactaatatttcattaggtttaattttataaaaatgtattatattaataatagaattcccagtttcattcataaaagtatttggagaaaaaaataatattttccttttatgattaataatctttgctattttacctgtaaattttttttcttcaaaaaaacatcctcctaaattttcaactattttatataaccaccatttacctgcattatgcaatgtatttgaataataaacatctggatttcctaaaccaataattaatttaatgttcatgataataaaaaattattttttattttcctttgtaacggaagattttataaattcaattttgcatatcggcctattatctttcatttttacaagatgaaaaattgaaacacctataggaagaggaatttgagaaaaatataatatttgattaattttcatattagaaacatcaacttctatatattgaggtaaaaatttaggtaaaactaaaattgtaatatatttggtaaaatataaaattttaccgcctgattttataccaggagaattatgtattcctttaaaatacaaaggaacttttatttttaatttagcataaaaatcaatacgtttaaaatcaatatgcaaaattttggttttataaggatgatattggatatcttgtaatataactttttccttttttttatttattaatatattaattatgctggagaaaattttttcttttttcaaaatatcaagaattttattatgattgatactaatatgaaatacagaatttgaatttccataaattatggctggtatataacttttttctcttcgtaattttttgcttgcttttctacctaaatcttttcgatcaatagcttctatttgaaaatagctttccatattttttccttctaataaaaaaattagatcatattttataatataaaattagataaaaaatgtacatcaattatattttttttaaaatttggattttcaagtattttttgatgcaagggaatattagttttaattccatcaatatatgtttctataagtgcatttttcatcaattcaatagcagattctctatttttactataagaaataatttttccaatcatggaatcatagtatggtggaatagtatatccactgtaaatatgcgaatcaacacgtatacccggccctccaggtggatggtaaatatttaatgttcctgggcttggaagaaatgtttttggatcttctgcattaattctgcattgaatagaatgtcctttaatattaatatcattttgatgatatgttatagtttgattggatgcaatttgtaattgttctttaactatatctatacccgtaacaaattctgtaactggatgctctacttgaatacgagtattcatttcaataaaaaaaaattctcctttttcatataaaaattcaaaagttccagctcctcgatacataatttttttacaaacttccacacattttttagcaagattttcgcaatcttttctatttaaagttgaaggagcttcttctaaaactttttgattacgacgttgtatggaacaatcacgttctcccaaatgaatcgcattaccttttccatcacctaaaatttgtatctcaatatgtcttggattttctaaaaatttttccatatatatactttcatcaccaaaactagcttttgcttcagttttagtcatatcaatagaattagaaagtttttctgggtcatatactactctaattccaagaccaccaccaccttttgtagcttttagaataatcggatatccaattttttcagctaaaatttgattttttttagtatcagaatctaattttcctaatgatccttctatacaagatattccatgttctttcataatgttaattgcagaaattttatctcccatgtttttcatattttctatagtaggacctataaaaataaaaccactatcttctactgcagatacaaaatcagaactttctgataaaaatccatatccaggatgaatagaatcgctatctgttaattctgcagcactaataatagcaggaatatttaaataactttttaaactattagatggacctatacaaaccgattcatcggatagtttaacatgtttaagatttctgtcagcagttgaatgaacagcgacagtttttatttgtaattctctacaagctcgtaaaattcttaatgctatttcaccgcgatttgcaataagtagttttttaatcatattttttctctatttataatctattttaaacacgctattttttattttattcaagaataattaaaggttgatcaaattctacaggtgaagaatcttcaataagtattgattttattattccagatttatcagattcaatatgattcattgttttcatagcttcaattataccaattgtctgtccaattttaataaaagatcccacttcaataaaaggttttgcagtaggcgaggaagatcgataaaaagtgcctaccataggtgattttattatatttattgaagaataaatatctgaaacttgtttttccttatttgaaaattttatagaattagatttttttaattttttttttgtttctctttcagaagataaaatattagatacatctaattttttagataattgaatagattcttcaccttgaactattttcatatcagataaagaaaaattatccattaattcaagtagcttttgtatgtctttatgattaattttcattattttccttttatattaaaatttaaaatcataagatataaatatcaaaaaaattgtttaaatattttttaactttaataaaatattaagattttgccttcatatttttttaattcatatttttttaaatatttccattaatttttaataaaaatataatttttttaacataatttaaaatatttttttataaaatgatgttaaaaataaaaaatatagttaaatcattaaaatgattaccacaaaattatagaatctaattaaaaaaatactataaaaatggtgggtactgagggactcgaacccccggccctcgccttgtaaggacgatgctctaccactgagctaagcaccctaactttattttattaattttaataggagcaaaaatgatgtcaataattatatattaagaattaaaaaatttgaatattaaataattggctaaaattgtctgttgttacatgacatatatctgaatatgatagatttttaatttttgaaatgcatttagcaacataattaacataactaggtttattagattttcctcgaaaaggatgaggtgttaaatatggagagtctgtttcaattaaaatacgatttaagggaatttttcgaacaagatctcttaaattttcagaatttttaaacgtcaaaattccagaaaaagaaatatacaatcccatatctaaaataattttagccatttcccatgattcagtaaaacaatgaacaacacctaaattaacgttatatttttctaagatagctatagtatcttgcgaagcatatcttgtatgtataattaaaggtgcatttaatttcttagatgcttgaatatgattaataaatctttttttttgcacaagaatatgtttttcagatttagttcgataataatctaatccagattctccaatagcaataattttagagtgtgcattgaaaatatttattaaatccaaagtagatggttctttgccttttatttcgttgggatgttttccaattgatgcataaatattgttaaacttttttgtaattggtattattgtttttaaattttctatgtttaagcatatagaaagaatatatttgacatttttatgatatgcttcatcaataatatcagctaaattcatttttaattcttttaaatttaaaatatctaaatggcaatgtgaatctactaaaattggcattttaaatcctccgtatttttaaataaatatatagcatatatatttctttgaaagaagattaaaatctttttttaaagataaatttagagaattattcattatatgaataccattcaataaataatccttcaagaaataattctgtattaaataaataatctatttttataattttttttctttctattaaataaaagtcaataagacaaaaccattgagataaagattttttttttgctaatttccaaaaaatagaatttttttttttaaaaattaatatatatattaaattataaactaattgtattaaactatttattattaatacaagatcaatatcttgaagtttttttgtttgaaatattggtgtttttttatctaaaaaattttgaaaaacagaatttattttctttaaatatccttttttttcccaaatttttaaataaataggaccaaatccagggatattaaaaatatttaataaatttttagaattattaatttcatattcccaaaaaaaattttttaaattttgatttttttcttctaaaaagaaattcatataccaaatttgacatcgactgcgtattgtaagtggtatagattctaaataatctgtagtcaatattaatatagttttttctcttttttcttctaaaattttaagaaatgcattatacgcaaataaattcatattatgagatttttctataataacaacacgatatcctcctatccaagatgtcctttgaaggaaaaaaataatatttcttatttgatctatttgaatttgatttaattttccttggggttttatatgtaataaatcaggatgttcagataattcactgctattacataaaagaattttttgagcacacaattttacaaaatgtaattttcctattcctggaaatcctgttaataatagcccataaggtattttattattttgtaaatgccaattaaattttttccaaagagttttttgccaaaaaaatatcataataattatattttaaaaaaatataaagaaattataatctttatttagaataaaaatatagattttttatttaaaaaatatattttataattataatttattataaatataaaattaaaaaaattttttaaaatttaagcacgtaactcaattggttagagtatcattatgacataatgaaggttagcagttcaaatctgctcgtgcttaccataaattattatttaatcctcaataaaattgtgaatatatttctttgaattagatttaaattgaacaatattaatgaataaatatatttttcatttaaaaatgatgaaaaaaaattatagtattattatactaataattatatttgaataaaaatatttattttgttgtaatatatagcaatgaaaatattcaaaatttatcatgcaaagatatagattttatagagaacataaatttataattccattgattaatgacataactagaaaaattgcttctactaatttccaaaacaatgaagaaatctctttacttataaaaaaactttctaatttgcaattagttttaacaaaatattcagaacatgaagataaagcatatcattcattattagtgaataaaggatctaatatacattatgatctagaaaatgatcataatgattatgaaaaaaaattttgtgatttaaagaatttattaaaaataataaaagatttaaaaaataaaaaagaaaaaattgcatatggttataaattttatttaaattttagagaatttgaagttaaaaatgctattcatatgaataatgaagaactttatattatgccaaaattacaacaattatattctgatgatgaattgcaagctattgaactaaaaacatataaacttatgaaagttagtgaaatcattcatatgatgaaaactatttttatatatatggatgcaaatgacagattgcattattttaatgatattaataaatcttctccagaaaaaataaaacctattttatgtagtattttaaaaataaaaaaaaataactcttatcttatttctaaaaaagaaaaatattttttattaaattatttttctatttcaaaagaagaatataaaaatattaatgtagaagataaaaataaatatttatgggaattatcagaaggggaatttatagaagaaaatatgagtatgaaatcacaacatgatcctaccagaaaatattaaattaaatttttctaaaaaatatataaaaaataaatggatttttacttaaaattaggagtaataaatggataaaaaaatattaaaaccttgttatagaaatgattctatattagatcataatcaattaaataaattacatgaattaaccccaattatttttggagcaagtgcttttcaatacttaaatgctggatctgaaataggactttttgaattattatattattctggtccaaaaaaaaaatctgaattaatgatagaactcagtttaaaagaaagagctgtagatattttattattaggaaatacatctctaaatttaattaataaagaaaaatctttttataaaaattctttaataatacaaacaatttttgaaaataatatttgggatattttcaaagatttaattgcttttgagcaatatattgtttatcttgggcaatttgattttacagattctttaagaaaaaataccaatattgggttgcaaagaatttctaatacatcaagcagtctttataaaagttttaataaaaataaaaaattagaaaaaatattctataattatatgaattcatggacccgtctttctaattattatttaattaaatatattaactttaataatgttaatcgtttacttgatgttggaggaggaacagcaattaatgctattgctttagcaaaaaaatatcctaaattaaaaattactgtttttgaaatcgatgcatctgcaaaaatagctcaaaaaaatattcaatcttctggattatcaaatcaaataaatgtcattcatggtgatatatttaaagatcaatttcctactggatatgattgtgtacttttttcacatcaattagttatatggactcccgaagaaaatatagaattattacataaagcatataaaattttatcttctaatggattagtaattatttttaattctatatctaatgatgatggaaaaggtccattattagcagcactagatagtgtatattttgctagtattccttcggaaggaggcatgatttattcttggaatcaatatgaagaatggttgaaaaaaacaaaatttcaaaaaatttctcgaattaattgccataattggacaccacatggaattataaaagcatataaataaattaagagatattcgatgaatgaaaaagatacattaaaaggaagctatatattttctgcttctccaggacaagaaaggctctggtttcttaaagaattgaatagtcaattcggacctgcatataatattcctgctttattcaaaataaatggatttcttaatataatttctttacaaaaatctatgaataaaatagtagaacgtcatgaaatattaagaacagcattaatttatgatggaacaaaattattgcaagttataaaacctaattttttaaaaactattagatatgtagattgtacaattaaagaaaaaagaaaaaaatttttagaatcaagtttgatacaagaatcatctgttcattttaattttacacaaccaggaattttcgatttaattttatataaatttcaagaaaaagtatattatatattaatcaatatacatcatattattagtgatggtatttcattagaaatttttgtgtatgaattatttgaatattattcttttatagaaaataaaattaaaattaaaaaaaaagatttagaaatacagtttgctgattttgtaaaatggaatgaaaaatggatttccagctcaaaatatttagaatacgaattattttggaaaaaaaaacaaaaagattttgtattaaatttaacattgcctaaaagaaatagaaatatagatacaattatcggtaataatgtaaattttgaactttctagttctattacagatttattaataaaagaagcaaagaaattgcatgtttctttatacgcattttatctttcaatttttgcaattcttatttattttttttcaaatcaaaaaaaatttttaattggaattcctcttgcaaatagaaaaaatcaacaaacacaaaatattatgggatttttagctaatacattagttcttaatattaatatcgatttaaatcaaaatttatcagattttattaaatataatcataaaaatattttaaaacttatcaagttagaacgatttccttatagttctttacataaaatttcaactaataatatacataatagcgaaccaatttttaaagttatgtttggttatcaagaattagaaaataaaaaatttaatataaaagaattaaatattgaaagaattaattttaatacaattttttcaaaatttgatatctctctttttatgtttcaaaaaggaaaacaacatagaggattattagaatgtagatcccatatttttagcaaaaaagaaagtgaaaatttttatcgatatttttctaatatatgtagaattgcaaaaaataccaatattttaataaaaaatattcagttttatgaaaataatgatattaaatttgcaaaaaacttgttaaagaatcttgataatttatatcttaataagaaaattttagaaaaactagaagagtttaatataaaaaataaaaaattttctatattggatacaacgtataaacaagtgcctattaatattcctggaatattatttatcaaccatcacaatacttatcttaaagtaagactcacttatgataaaaaattaaatcttattgaagataataaaaaagatcaatctaatataatagagaataaatatcacgattttataaaagcaaattctaaaactgaaaaaatattagaaaatatatggaagagtttgctaagattgaattcttcactatccattcatcaaagttttttttctataggcggccattctattttagttgcgaaaatggtaaataatattaataaaaaattcaatattgtaatttccataagagatatatttttgcatcctacaatatcccatattgctagtaaaattgaatctcttaaagaaaaagaaatccataatacaaatataaatcctcaaaatttaaaaaatgaagacattgtagaaatatataaagatattaatggaaaaaaaatttaatttaaaataaggggtataattttgaaaggtttagatataaaaatattaaaaaaaaaaattaaatctggaaaaacaaatctaacacataatcaacaaagattttgtttttttctaaatatggattctaattttccatcttcagatgcatatttttttgaagcaaatatattttttgataaagcaatattacaacaaagtattgcttttagcataacaaattttcctatttttagatctatttttattaatatttttggatctccaataagaaaaacacaattaagttctattatttccataaaattagataatctttatcaagataataataaaattgataaagatcaatggatctctaataataaaaaaaataatacaattaatatatcccaaggaccattatttaatgtattttgcttaaaacattctgataaaaaattcaatattctttttttagtttcccgattagtttcaaataaaaaattaattatatcttttatgaaaaatatattttttagatatcaaaattttttatatcataatgaaaatgaaaaaattatttcatatgaaagaaatatttcagaaaaattcttttatttagaaaatcaatggattgaaacagaaaattttaaaaatcatattaaattttggaaaaaagaagttaaagatttatctgacttagatttacaaacagattttaaaagaccagaaataaaaacaaataaacaaaaatctgtttttttaaagttgggaaaatataaaattttaaatatttttaataaaatcaaaaaagaaaaatataattatgaagaattttttttatctatatttgtaacaattttatataaatattctaataataataactttgctgtaggagtcaaagccaataaattagaaaaatattttgataaaaacaatatttctcctattgaaaatgaattaccatttaaaattaatttaaattctagtttttcttttaaaaaaactctttcaataataagcgaaaaatataatttatttttaaggtatagcactttgcctataaagattttattggataatataggaataaatagagatttaaaaaaaacacctttttttcaagtatcttttcaatacgaaaatttttcttttcctatttggaataacaaaaaaaataattttctaaaacaaattcctattttagaaggaattaatattatggattttacattttgtgtaatagaaactaaatcgtcttttatattacgtattgattttaatccagatctttttttagattcatctatgattctttttctttctgcaatagaagaattattaatgtttatatcaaataaaagttgggatatctctattaaagatctatctattataagtaatatgatgtttaaaaaaatagaaaaaagatggaatgctcctaaaaaaatattgtttgaaaattttgaggttcacaaaaattttgaaaatcaatgtaaaaaaacaccttcaaatatagctataatatgtcaaggagaaacaattacttatagagagttaaatgaacgagcaaatcaaatatcacactatttaatatacaaaaaattatcatttaatgaaaaaataggaattcttatggatagatcgatagaatttattatttccatattagcaatcctaaaaataaattgtatttatgttcctatagatgaaaaatatcctattgaacgtatcaattatattattaatgatagtcaaattaaattattaattacaaaaagttatattcaaaaaaataaaaatataatatataaaaatttaatttatttagataaagattggccgttaattgaaataaaaagtagagaaaatttaaattttagtactaatatccaaaaaaatggcatgtatatgatttatacttctggatctacagggcaagctaaaggtgttattttaaatcattttggagtattaaataatattagttggagacagaataaatggcatttaaatgaaaaagatcgaatattattaaatacatcttttagttttgatccttccatttggtctattttttggccattactttttggaggagcatttgttatagttcctttatctatacaaaatgatatttatgcattaataaaattaataaaaaaatataatatatctattattggaactattccacatattattgatttattagtatcaaatattgccattagaaattgcaattctcttagacttattttaagtggtggtgaaccattatctcaaaaaattgttcaaaaagtttttaatcgtacaaatgctaaactttttagtttatatggtcctactgaagcaactattgacgcaggattttacgaatgtaaacccgatgatattgtgcaaacagcaccaataggaaaagcaattgataatacaagaatgtatattttagatgaaaatttaagacatgtaccagatggagtaaaaggagaaatttatatttcaggaccaggtgtagctctaggctatcataaaagaaaagatttaaatgcaaaatcttttcttaaagataatattttttattctgaattaaaatatatgtataaaacaggagatcttggtgtattttgttatgatgataacataaaatttttaggaagaattgataatcaagttaaaatatatggaaataggatagaatgttcagaaatagaatcagttttaataaatataaaaaaagttaaagaaagtgctgtaatagtagacaatctttatactgaaaaaactaaattaattgcttttttagcagtatcagaattagatgtaaaaaaagaagatattcaaaaaaaattaaaaaataaactgccaaaatatatgctgccagataaaattattttacttatatctttgccaaaattagaaaatgggaaaattgataaaaatgctttatttcgaatctataatacatcaaaaaataataaaagcgaacttttagaaaataaattacctaataattctatagaaaaaatagtatttaaatatttttgtgatgttttatctctttccaatattagtattcatgatgatttttttaaattaggtggaacatctatattattagcaagattatcaaatttattattcaatcattttgatatttctttacctcttcatcaattttttaaaattccaacagttctaggtgtttctaatataattgttaccttgcaaaaagaaggaattgataaagctctgcttgataaacatatttcaaaacttgaagaagatgcagaattaatagaagatatttctccaaaaaatcttcctaaaggaaatttttataatcctaaaaatattttaattactggaagtacaggatatataggttcttttattttacaagaattattaattaatactaacgctactatatattgtttgattcggtctgtaaatcctgagaaagctttgataaaattaaagaataaaatgaaagaattttatatttggaaagaagtgtacacaaaaagaatagtttgtttagttggagatctaggcgaaaaaaatattggattaaataaaaaagtatgggaaaatctatctaaaaaaatagaggttatttttcatgctggcgctttagtaaattttgcttatccttattctgctttaaaagctgcaaatgtagaaggaacaaaagaaatttttcgattttcatgtaaaaatctattaaaatcagttcattatatttcaaccattgatgtattattagctactcatattcctagaccttttttagaaaacgatgctcctttaaaaggtagcattgatattcctggaggatatactggtagtaaatgggttgcagaaaagatagcacattctgcaatgatacgaggtattccaacttctatatatcgtcctggactagttatgagtcattcaaaaacaggagcaactcaaacaaatgattatcttttggttgcatttaaaggttttataccaaaaaaagttattcccgaatatgcaagaatatttgatattgttccagtagactttgtagctaaatctatagtttatgcatcaatgcaaaaaaatgtacatggaaagttctatcatatttttaatccaaagcctactactttatatcaattttgcaattggattaaaaattatggatattcgtttgatattattccatttgaaattggtagaaaaattgcgttagattctaaagaatctgatcccctttacccgctggttccattaattagagatgcagatccaaatcctcacagacctttagatcctaaatatattaatgaagtgcaaccagaaattgaatgtaaaaatatgaacactattttacaaaaaagtggaattatatgtcctaatatgaatgaaagattaacacatttatgtttaaaatatttaataaatattggatactttcctcatccgaagaaaatataaatttttaaataaaataaattattaatgacatgtatatttttttaaatttataaatcttagcaaaattcaacaattcaattatgaaaaaaatgattaattataaagaacatgaaattacaagttttgtagatataattttattgagaagtcattccgttccagataaaaagatattaacatatttaacatcttttgatgaaaaaaaagaactgacttataaaaaaataaataagatttcacaacaaatagctgtaaaaattttgcattatctttctcctggagatagagctttaatttttcataaaccaagcattgattatattacagctttatttggatgtttatatgcaggaatcattgctattcctgtttatggaccagaacatggaattaataaaaataaattatatagacttaaaaatattataaaagattctggtgcaaaaggaattttattatcttataaagaattaaacaattgtaaacaatttttttctaatttttatatacataaagaaaaaatacattatatcactacagatgatactagtaatattgattttcaagattggaaaaaaccgtattttaataaaaataatacttctattattcaatacacttcaggatcaacatctgatcctaaaggagttatgcttaatcacactaatttaatatccaatatattatcaattcaaaatatatttgaaatgaaaaaagacaagggaaaagctgtaatttggttacctccatatcatgatatgggattaataggaggaattttaacaccaatatttgtagattttccattaattcttatttcaccattattatttattcaaaatcctatattttggttaaaattaattagtatggaaaaagcaacaattactggaggtccaaattttgcttttgatttatgctctaataaagcaataataagaaaattaaacaatatagatttatcatctataaaacatattttttctggtgcagaacctattaatccagaagtgattaataaattttttgaaatatatgaaaagtttggattatctaaaaaatcttttagtacttgttatggccttgctgaaagcactttaatggtaacaagttctaaaatagaaaataacaaagaaattaaagaaaaaaaattcttttttaagaaaaatattgtagaaatttttaaaaaaaaccaaaaatcattttcattatctaaaaaattattttcttgtggaaaaattattcccaatcataaacttgcaatagttgatcctaaaaaatctaagaaactaaatgaaaaagtcattggagaaatatatgtaaaaggtccatcagtttctaaaggttattggaaaaatcctaaaaaaacaaaaaatatatttcaaaatttttttataaaagaaaataaaaaaaaatcttatggatggttaaagacgggagatttaggattcttatacaattctcaactatatgttactggcagaataaaagatttaattattattcgaggagaaaatttttatcctcaagatattgaaaattatgttaaagaattaaattctaaaattcaattatgtaattctgcagcatttgaaattgacaaaaatcatataaaagaagtagttttattgcaagaaataagaaaaaaaaatttatctgaaaattttgagaatcttgctcttgatataagaaaatctattttagataaattaaatttattaattcataatataatttttatagaaaaaggagcattaccaaaaaccactagtgggaaaatacaaagatttttagcgaaaaaatattatttaagtaatagttttaatataatattttcttttaattctcaattaaaagaaaaatacaaaaaaattaattatgtccaaaaatactatattcaatccttaaagaaagaagaaaaaaaaatttatttttcaataataaaattcattaaaagatatcaaaatctcaataaagatattattaattttacaattttagaaattggattagattcattgcatattatggaattaaaaaattttttagaagaaaaatataaaattattttaaatatgcattcttttgtagaagatacaaaaatttttactttagtaaaagaagtttttaacaaacataaggaaaatatacagaaaatatatataaaaaaggaaaagaaaaaaaatgttttaaaaaatcaagtaagtaaatatttttctgttgatcctggaaaatcatcaatttattataattatcttgtacaaaaagaaaattctatatatgaaattttcagaattattaaaatatctaaatctataaatatagaattattagaaaaatccattcatatattgttaaatatgtatccaacattaaaaagtagatttatagtaaaaaatactggaatagtgtatcaggaatatcctgttgaattatccttttcttctatttttagaaaaataaattgtaaagatatagatttaaaagaaatatgtaatatctttttaaaagaacgttttaatatggaaaagggaccactttttaatattatacatataaataatgtaaaacttgattataatattctaatatttaagattcatcatattatttcagatttttggtcaataattataatttatcaaaatattgaaaatatttataataatttattaaaaaataattctattaagaatataaaaatacatgaaacatcccaggatgtacaaaataaaaattataaaaaatacattcaatccaatcaatttattgaagacaatcttttttggaaaagatatttatctaaatataatttattagaaaatactaataatattaaaagaaaaaatattcaatcatttcaatttaatttaaattttaatttttataataatttattaattttttctaaaaaaaaaaaaataacaccttataccatattattaattatataccaaattacatattatcgaatatataaaagagattatttcattactggaactccagtagcattgcgtgatgattatcttttacgaaattatataggatattgtgtaaatattttaccaattgtttcagatttttcaaaacaaaatgatatatattcttttactgaaaaagttaaaaatgatattaaaaatatattacaacataaatatttttatttttcaaaaattatagaattattgaaattgcctagaaatacggattatattccattatttaatagtctttttatttaccaaacagatcatataggatcttttaattttttaaatacaattgcagcaaatataaaagatagtgaatttcaatttttaggatatccagcatctatatggtatacaaataattttaatttaatgcatcattttatttttaatatttctgtaaataaagaatcctattcaattaatattgaatacgatgaaaatatacataataaaatattaataaaaaaattttctgaacaatttaaattaacatttcaagcaattatttttaataaaccaaaagcaattatagaagaaaaacaatatttgttttatcaaaatataaattctactaataaaaaattttttaaatctcaatattttttagatcaattgtttaggaaacaagtaattaaaaatccaaatgcatcagcaatcatttttaatgacataaatattacttatcaaaaattgaataaatatgttaatagagtttctcattatttaataaatcatattttaaaagatgaaattcttattgctattcttatggataaaggaatagaacaaatagttgcatgtttagctatcctatccataggaaaagcttatttacctattaatattaatttttctaaaaataaaattcatgaaatgatggtattagggaaagtaaaaagatttttaactcaaaaaaaatatttaaaaaaatttaattttaaagattttcaatcaattgatgtaacatctataattgaaaattcttcttttaaagaatctcaagaatattttccaaagtatcaattaagaaaattaaatgatcttgcttatgtaatttttacatctggttcaactggcaccccaaaaggtgtaatgattgaacataaacaagttgtaaatactattttagatataaatgaaaaatttcaagttaataatttagatagaatattagcaatatctaatttagattttgatttatcggtatatgatatttttggaatattatctgctggcggaacattagttattgttccatcaaaatttacaaaagaaccaaaatattggttatatgcaatacaaaaataccaaattactatttggaatagcgttcctatgtttaaacaaatgtttattgaatatttacaaggtatagataaagagagtttttataaaaaaattatattaaaattaattttattaagtggagattggattcctctagatttgccaaaaaaaatatttaaaatatataaaaagaattttgattctttaaaagttgtatctcttggaggagccacggaatgttcaatatggtctaattattttattattaataaaaatattaaatataaaactagcattccttatggaaaaccattatctaatcagcatctatatattttagatgctttaatgttgccaacaaatatattagttccaggttatttatatataggtggatttggagttgcgagaggttattggaatgatcttaaaaaaacaaatgaaagtttttattttcataaagaaatagggaaaagaatttattttacaggagatatgggacaataccatccggatggaaatattgaattcttaggaagaaaagatagacaaatcaaaattaatggatacagaattgaactagaagaaattcaaaataaattaaaatctcatgtatatgtcaaagattcgtttattacagtaaatcagaataatatttctgcaaaaattcttgcttttattatattacataatagttcatcaatgatgtctcatacaaatataaaaaaggaactgaaatcatttctttataagaatttatctgaatatatgattccaaatcattttcaatttcttaaaaaatttccattaagtaaaaatgggaaaatagatgaaaataagttatataagatgcataatgttccaatattaaatatacaaaaatctgcaaatacaaaattgcaaaaatctttgaaaaaaatttggaaagatttattaaaaatcaaaaaagatatatatataaatgataatttttttcaattaggtggatcttctcttttagctgttcgtatgacaaatttgatatcaaaaaaattaaatttaaatattgatgtttctgctgtttttaaatatcaaacaattgaaagtttagaaaaatttttacaaaaagacaaaataaaaatagaaaaaaataatattactaaacaagagcgtatcctatattatgaatagtatcaattctatatatttaaaaaataataaaattcttacagaaaaaataataaaaaaatgtatgttaattagattagttgaagaacgattattgcaagctttttcagaaggagaactttatggaacaatacatacttgtataggacaagaattaataggtgttatggcttgtcaatttataaatcaaactgatacaattttttctaatcatcgatgccatggacattttttatcatttactaatgatgtagaaggattaatttctgaaatatatggaaaaaaaacaggagtttgttctggaataggtggcagccaacatttatataaaaataatttttattcaaatggcattcaaggaggttttatgcctgttgcagcaggcttagcatattcttttaaagaaaataataaaattgcaattatttttattggagacggaactttaggagaaggaattctttacgaaacatataatattattgctttattaaaattgccattactcattattttagaaaataatttatatgctcaatctacgcatcaaaaagaaacattatcaggagatatattaaaaagagctcaagcttttaatatttatgcagataaatctgatatttggaattggaatgcattatataaaaaaatggaattcatgattaattatgtaaggcattatagatctccagcatttttagaagtttcttgttatagattaaaagctcactctaaaggagatgatgacagagataaaaacgaaataaatttttataaaaaaaaagatcctgtaaagattataatggatcaaatttttcataaattgcaaaaaaaatctattatttctttaataagagaacgtatagaaaatgctatttgtaaagcaaaaaaagatgtatatgctaattataaaatctatcaatataagaattataatatctttaataactatcaaaatttatatgttaattgtaaaaaaaacaaacgtatttctacattattaaataatacactacataatgtaatgaaagaaaatagtaatattatcttattaggagaagatatcaaagatccatatggaggtgcctttaaaataactaaaggtttatcttctaaatttcctgatagagttattaatactcctatttcagaagctgctattattggattttcttgtggcatgtctttatcaggtttgttgcctattgttgaaattatgtttggagattttattacattagcttttgatcaaattttaaatcatgcaagtaaattaaaatatatgtataattataatgtttcaactccgataattatcagaacccctatgggtggtggtagagggtatggaccaacacatagtcaaactttagaaaagcattttttaggaattccaggcattcgaatttttgcaataaataatttatttaatccagaaatattatataaatctatattaaaaaataatcaagaattatcaattataattgaaaataaaattttatatacaaaaaatcttttatcttttcctttaaaaggatatttctataaattcaaagattatccacaacctactataatgatgttgcctaaatccaatttaattgatattacttttattacatatggaggattagtagatattatagttgaaatagtagaagaattatttgaagaatatgatttaattgctcagcttatatgtcctatacaaatttatccatgtcaattatctgaattttctaatttaataaaaaaatcgtctttgatagtcttaatagaagaaggacagggctttgcaaatttcagtagtgagatgctttctcagcttattgaaaatgataaatttaaaaattgtaattttttaagatgttcttcagaaccatctccaataccagcatcaatacatttggaagataagatgctaccaaataaaacaaatatacttcgtaatattttagaggtttataatgaaaaaaaaaatgttaattccaagatttgaggcaaatgataattccgtaaaaattattgaatggttagttaacgatcgtgtttttattaaaaaaaatactcctttattaaatattgaaacatcaaaaacttttcaagaaattaaaagcaaatatgatggttttataaaaaagatgtgtcaagaaggtgacacacttcatactggagatatatttatagaattttatacaaaattagaagatcttttaaagaaaaatacttattttaaaaaaaaaaaagatactgttttaagccgtaaatctatataccaaaggttttctaaaaaagcaaaaaaaattttattagaaaaaaatattgatatatcttcttgcacagaagaattaataactacaaaagtattaaataatattacaaataaaatacaaaaaaataaaaaaaataaagatttaataaaatattttccaaatttaaaaattaaaaaaaattcagatattaaaaatcgagaaatttctgttttagaaaaatcagatggaaatattttttcaagctctattatgattcaattatcttctgaaaaaattagagaaaatataaaaaaaatacctaaattaaatggtcagattttcccttatcttatgtatttttatatacaagaattatccatttcaccaaaatttaccgcattttatagagaaagaaatattatttattataatagaattaatttaggagttttaatagataataataatatattgcaaattattgttttaaaagatgcaaataaattttcactattagaattgcaaaacgaattaattgataaaatatgtagatgttatgaaaataatttagaaattgatgatgttgtacattctacaacaagtgtgtcggatttatctggaaataatattatatcttttcagcctataattaatcaaaaacaatctgttatccttggaataggaggagatactaatcttttaggaaaacctataacttttaatatagtatttgatcatagaattttaaatggaaaagaagttgcaatatttttagaaaattttaagagaaaaatactacaaggaatatactgatagtaatatagatgtatattacaaacagtatataattgttattatatatctaattttttacaatatatactgtatatatgtataataaatttgaagtaattattataggagccggtccatcaggtttgatgttatcaatagaattagctttaagaaatatttcatgtgctataattgaaaaaagaaaatctagattaattgaaacacgtgcatttggattgatgccattaactttaaatttattagatatgcgtggattagctaattctatgatatcagaaggtataatatgtaactatgctcccttaggagatggaaaaggaaaattatattttcattcattaaaaacgaaatttccttttttattaagcattccacaagagaaaacagaagaaattcttgaaaaaagaacaattcaattaggtgtaaaaatttttaataattatgaattattaagatttgaagaaaaaaatggagattttttattattttgtaaaaataaaaaagaagaaaatatttttatatctcgttatttaatagggtgtgatggatcttatagcagtgtaagaaatttagcaaaaataccatttacttttttaaaacaaaataaaacacttatgcatggtgatgtttatttaaaatatcctccaaaagataaaatatttgctaaaacttctaaaagagggatgattgccatttttccccataaaaatggatcttatagagctattgcactggatcaaaaaaaaatgctaataccagtaaatacaaagttaacattagaagatttttcagaaagtttaatatctttatcaggaggttacaactttggtataaataattttatatggcttaaaaggtttagggttcaacaaaagcaatctcaaagttatcaaaaaggaaaaatttttcttcttggagatgctgctcatactcatatgccagcaggagggcaaggattacaagttgctatacatgatgcgtttaatctaggttggaaacttgcattttatatcaaaaaaaaaacttcatataatttattatcttcatatacagaagaaagaagaaaaattaatgaaattgctatgaaaagaagttctatgttatttaaatatgaaatagctaatgatatatttagcatgagtttaaagtggactattaataaattattttcttttaaatttatgcaaaaatattttgcaaaagacatgagtggattgtctactaattatcataaaattttttctaaaaaaaaaaattataaaaaatttaaatgtttgggatattttattagagatataaaaatttatacacatgataatacactacgttttttatattcttttctaaaacaaggaaaatttgtatttattagtataatacatcaaatttcttttatttcatggaagaatacagatattatttttcttgcttctgatgatataaaaaaaatatatggagttaattgttgtctagtaaggccagatggtataatttgttgggctggattagatacgaaaaaatttaccaaaaatattttttatgaaattatttttttaaagcaagagtaattccatcagcaaatggaagcaaactgatttctactctattatcagataatagaaaattattaagatcattaattattttagtatcagcattatatttaatgttttgagatacagtaacttttcctgaccataatgtattatcaaataatattaatccaccagcttttaataattttaaagaatattcataataattaatatagttttctttgtctgcatctataaatataaaatcaaaatactcttttttatgcaataataatttttttaatgttagtaatgcatcattaatatgtagagaaattttatgattaattttttctattttccaaaattttttagcaatatcagtccattttatattattatcacatgctattaattttccattttcaggaagagatttagcaatacatatagaactatatcctgtaaaaactcctatttctaatgccatttttgctttcattaattttattaaaagagatataaactgtgcttgttccggaaaaatttgcatatttctttctggcaatttatttgttaaatatctcaattttttaagagtatgactttctcttaaagaagtatttctaatatattgaagaatattttcatttatctgaatgtgatttatcataaaatattatcctttaagaatttttaatcttaattttttaaatttttctatttcttgaacagccgaatattcattagatcgcaaacttcctgatgcaggacctacaaattttccacatacatatttatgtgcatgatatgctttttttaaagaaattataaaactgttatattttttttgaattataggacaggaagtgaaatttaattttcctatagatctcatacaattttttaccataaattggtgatctctccaatttaatccactcatttctggttgtgaaattggaggcataagagtaggtcttacattttcattatatgatttagaagaaaattctcctgtatagtacaaagcaacttctgttgctttcataagttttatagcattatctaaatataataaagattgcaaaaacttttttttagaatattcaaaaataaaacattgtaaagatataataagaccttgtattattaccataaaaagataatgaccatgaatccatcttttgtatgcattatatttatctatataatttttaatttttaattttgaataaaatttattagaaattgaacaatgagtattaggattgtataaaaataataatgtaaacaatgtttttattaaaatattaaaattttttcttgaaagagatgttccacttttttttaaatctaaaaaaagtaaatgatatgttttgataactgagtaatttaacacttctaatattggcccatctactcgaattatacgaaaagcaagatcattatcatgatttttttttgattcataacaatcattagaaataatagaaaaattttttatttttttttcatatgattttaatattttttgtattattataaataaatcatttttatgtataatttcagaaaaactattttttaataaaatagtatttttagaattttgtaaaaaaattaattctttttgattatgtggcaacttttctggaggtaaaagtaaaaaattatttttcaacataaatatattcactcgtattatataaataataaaatatattataatttaatatattttcctaatttccaaaattttaacatattatcatagtttttagaaaaagggtttcctgattgtcctaaaggacatataaaataacttttattttttttatttaaatcaattatttgtctatatacaggtccagctttttgaataaaattttcatcatatggagatgcattaatagtataggcattgccttctgtagatatttttctattccataaatatttaattccccatattttaccaaaaataggattaataaattttgcttggtgaattttcccccatttccatttttctatattatttcctaaaatatttttaatattaactattgcttttttaaataaaatatacagaacatcagtaatatttttttttttatttaaacaaataaattttccgtttttttttaattgatcaataataaaaagaggatttggaaaattttgataatttataggtaatttaggttgtatttttattatttcttgaaaccaaaatgaaaatactgtagcagaaatactattacttgacatatttccattccattttttaaggtatattaatatttttttttcaaatttgttttgaggaattatttttaataagaaatcttttaattcataccataataagttatttgtatttatttgaatatctttcatattttttattgtcattttattcatattattaatcatatattcaattttttcagcacgatatggaggacctttccaaatataagtaagattataaggatattcattcggaataattttgttatttgcattaacaatatatcctttagatggattaaatacatgtggcaatttattaaatggaataaattcattccaagcattttttgaattaaatggtataacatattttaaattttctttttttcgaataggtatccttccaggaaggtaatatccaatattccctaaaatatctgcatataaaaaattcattggagctgctgtaaaatcttttaaagcatttttaaattctttccaattagaggcgtaattcgtttctattaaactttgaatagttttatcgtcagaatctaatcctgtccatcttatagctattttttggtttattatttttttatttatttggtcattttcttgaattaaattattaataataggaccaatatcagataattcaatttcgtgttgtatagtttttttttttcttactttaattttctcaaaaattttttttgtaggtcttgtcttatcaattaaaaataaatcggaacaatctagtcctgcgtcagttattccccaagcaatatttttattttctcctgaaataatgcaaggtatacctggaattgaagaacctctaatgtttaaagatggaccttgcatgttagctaaataacaaatattaggggaagataattctaaatgaatatcatttgctaatattggtttgcctgattttgttaattttcctgaaataacccatccgtttgatcctttgcctggtaaattttgaatattaagattattttgtatctcttgagagatattaataaaagattgcatattattattatataatacttgattttttttatttgtatttaaattatctgaagatttttgtgtataatctaataaattgcttttgtttaattcttctatatttaatgttgttggtgcgttttctggatattgaattctaatatcttcaatatttatatcagaggatttttccataataagggaattatttaatttatcttgccaagtatgatattgtaattgccaagcaattatttttgaccaaataaatgaatctatatttttccaatattttggtttatagaataatattcttaattctataggtcttttcccagatttaatatatgcatttactcctgctgtatatccattaataattttttttgttttaatattaaaatgtttccagttctcttttgcacatcgataaaatccccatgtttttaaatatttgtcttcctttatagttcttttcccaaaaatttcacttaatgttcctgaagcaatatgacgctgtaattccatttgccaaaatctatcttttgcatgcatatatcctaatccgtaaaaagcatcaatatcatttttagaagtaaaaatatgaggaattccataactatctaaattaatttttatttttccatacaaaccttgaattaataaacttttttttgaatttagcatatattttttacaaaaatattatattatttctataataaatttaaatggtatttaatactagttttattaatataattcggaaaactatagtagttatttataaaataactaaaaaaatatggtaccgagagcgggatttgaacccgcacaatctttatgattattagattttgaatccaacgcgtctgcctaatttcgccatctcggcatgatttttttaattagcatttttttttaaaaacaatttctttattaaaatttctttaatttttttaggattagcttttttatttttttgtattattttaccaagtaaaaaatctaaaatttttgttttcccattatgatatttaataatctcttttggaaaattatcaattacttcattgacagttttttctattatatttatatcattaatttgcaataatttttttttatagataatatcatcaatatgagattttccatttgtaatccataaattattaaaaactatttttgctgttttattagataataatttttttttaattttaaaaataatatttgataaatgatgtatttttataggagaatttataacagatagtttatatttttttagtttagataacaatattgatgtaatccaattagatgctaattgagagttttctaaacctacagaaaaaactaatttttcataaaaatttaataattgaggattttcaagaaacatttcgatttctttgttatcaagataatgttctgattttaaacgatttcgtattgaattgggcagttcaggcaataataaatgaatattctttatataagaatatgttactttaacaggtaataaatcaggttcagggaaatatctataatcatgttcatgttcttttatacgcatttttttagtaatatttttttttgaatcaaaaagacgagtttcttgaattacgaacttcccggattctaatagtgcaatttgtctttttgattcaaaaataatagctttttcaataaatttaaaactatttaaatttttacactcagtttttgtgcccaacattgaagatcctaaagaactaacagatatatttacatcacatcgaaattcacccttttccatatttgcatgtgatatttttaaatatcgtactaataaatgcaattcttttaaaaaagaaattgcttcttttgcagatgtaatattgggttttgttacaacttctaacaaaggatttccagatcgattaaaatcaatttgtgcatttttttctgtatgtactaattttcctgcatcttcttctaaatgagcatgatgaataaatattttttttatatattttttagaatcattaatagcaataggaatatatcctcccatcaaaataggtattttgttttgactaatttgatatcctttagataaatctggataaaaatagttttttcgaacaaataaaaaatatgtaggtatttttgcattaattgctaaacctaatcttatagcaaattctatagcacgtttatttaatatcggcagagttcctggcaatcctaaatcaatgcctgatacttgagtatttggagtgtttccatattgatttttcgccttagagaatatcttgctttcagttgataattggatatgaacttcaagaccaattgcaatattccattttatcataaaactttacctataaaatattttgaggtttttgcatatgccaatcagtgtttaattgaaattgatgcgctatatttaataatttttcttcagtgaatgcaggacttataatttgtaatccaattggtaatttttttacaaatcctgctggtatagtaattccaggaagccctgccatatttaaagacaaagtatacatatccgaaagatataataatgaaagatcatttttattttttccaattttatatggtaaaattggactagtaggacccataattacatccaccttttcaaaagctttttgaaaatcttgaaaaattaatcttcgaattttttgtgccttaatataatatgaattataaaattcagaagaaagcataaatgttccagctaaaattcgttgttttacaatttctccaaatccttctcctcttgatctttcataaagatcccataaattttttggattttgacaccgatatccaaaacggattccatcatatttagcaagattagacgaagcttctgcttgtgctataatataatatgcagaaatacatatatcattatgtttcattcgaatcgattttaattttgctcccatagattcgtatttttttaaagcatgttgaatggttagttcaattttaggatccaatccttttgaaaaataatcttctggaattcctatttttattccttttatagaattattaagtattttagtaaaatcttttttatgttctaaagaagatgtagaatcttttttatcgtatccagaaataatattaagtaataatgcacaatcttctgctgaatttcccataggacccgcttgatcaaggctggaagcataagcaattattccatatcttgatactaaaccgtatgttggttttaaacctgtaatgttacacatagaagcaggttgccgaatagatcctcctgtatctgttccagttgctataggagttaaattagcagatatagccgcagcggaaccacctgaagatcctccaggtattctagataaatcccaaggattcttacaaggtccaaaataactagattcattagaagaacccatagcaaattcatcgagatttgtttttcctaataatactaaaccagactttttgcaaagttttactatgtgtgcatcataaggagaaataaaattttttaacattttagaagcacatgtagtttttattcctttggtacatattaaatctttatgtgctataggaattccagttaaaatattggccttgccatctgctatttttttatctgcatattctgcttgttttaaagcatgattatatgtaattgtaataaaacaatttaatgttttattatatttaaaaatacgatcgagataatactttacgagttcaacactactaattttttttgtttttaaagcgtttgaaattgatttaagagaatgatattctatcacttttatttatttttccctaaataatacataatacaattttaattatattttccttattttgataaaaatgtaggaaccaaaaataatttgttttcatgatctatagaaggagcattttttaatatatatttattatcaaaatcttttttaataggactgtcttcttgcaaaatttgagttttatttgaaatattatataatggtttaatattattagtattaattaatgaaattttattcattacattaagacaaatatctaattgtttttttgtttgcaaaatttctttattatctatttttatacaagattttttggataattttttaatttcttctgtagttaaatacattttatacataaaataaaaaatttgttatttaaataaaattaaaatatcataatatccaaaatggataatatttcaatttataattgattaaattaatgttaactataaacaaagatattttatcaaataattttaatattttgaatataattttcttttgatataaagaaattttatttcaagattaaaaaattggaagtaaattatggatattttacaaaatgctaaagaaattttattattttccaataatttaacggaaaatgatattcaaaaagaaattaatattgctatgtcatacaatatagattttatagatttatatttagaaaaatctgaaacagaaaattggattttagatgataggattattaaaacaggatattataatatttcacaaggtttaggagttagaacttttttaggtgaaacaagaggctattcttatgcagatataataaacattaattctttaaaagaaagtataaaaagagcaaaaaatatatcttcatttcgaaaaaatattaaattaaattattttaataatgttaaaaaaaatcattgtgtatatatttctaaaaatcctcttgaagaatataaacaatttcaaaaaatttcttttttaaaagaaatagataaatatattcgcgaaaaaaatgccaatattattcaagttatagttcaattatatagttctttaaaaacaattttagttgctgcttctgatggtacttttgcagcagatatgcgtcctatggttcaattgagaatttctgttattttacagataaataataaaatagaacaaggaaatgcaggaataggtggaagatattcttatagagttttatttaatcctaaaaattggaaaaaaattgcagatgaagcaattcgaatagcattaataaatttaaaatctatacctttatcagctggattaatgccagtagtattaggatctggttggccaggtgttttgttacatgaagctgttggacatggtttagaaggcgattttaatagaaagggtgtgtcaaattttagtcaaaaaatgggaaaattaattgcatctccattatgtactgttatagataatggaactatcaaagataaaagaggctctttaaatattgatgatgaaggtacggaaacaaaaaaaaatattttaattgaaaatggaaaattagttggatacatgttagataaacataatgcattcttaatgaaaaaaaaatcaacaggaaatggaagaagggaatcttatgcacatattcctatgcctcgtatgacaaatacttatatgttgcctggcaattatgaattacaagaaatgatttcttctattcaaaagggaatttttgctgtaaattttaatggtggggaagttgatattacatctggaaaatttgtatttgttatgtctgaagcttatcttattgaaaaaggtaaagtaacaaaaccattaaaaggagctactttaattggagatggtccttctataatgaaaaaaatatctatggtaggcaatgatttatcttttgatttaggaataggtatttgtggaaaaaatggacaaaatataccagtaggagtaggacaaccaagtttaaaaatagatgaaattaatataggaggaacaaaaataaaataaaaaatgaattaatatcaatctcgatttttacaaactattcttgtatagtatcttactaagaatttagatctaaataaaatttaatttatttaattatttaaatgtattaagttttccaataaacaaatatcaatggtgaaaattatgataagatcaaggaatatctttttaatcggtatgtcaggtgtagggaagagtacaattggcaaacaacttgctaatgaactaaaaatggtattttatgactcagatgaaattattgaaaaacgatgtggcgcggaaattagttggattcttgatatagaaggtgaagaaggatttagaaaacgtgaaagcgatattatttatgagcttactgaaaaaaaaggtattgtgttagcaacaggtagtggggtagttttagaaaaatctaattgtaatcgactttctgctcgtggaacagtgatatatttaagagcgtcattaagattgcatgttgaaagatcattgcgtgataaaaaaaaatatctaaaacagaaacaaaatcaagaaatagaattgagaaaaattcaagaaaaaagagatcccctatataatagaatatctgacataattattgatgctaattctaacagtattcgttctattgttaatgacattttagataaaataaatgaaaaataatggaatgaatatagattaaataaaatatatagaatataaatttatttttaaaaaaataagagagaactcttttattcatattactatgatgaataatattattagaattctctctgtaattctacattagatatatgtaaattaaatgtaaaataaatttgaaaaattaatttaaaatatacattattaattttaataaattaaaatgatttttgtaattcaatttcctttagtacgttcatgatgttcttttgcttctttagcttgaattgataaagtagcagttggccttgccaataaccttttaataccaattggttctccagtctcttgacagtatccatatgtaccatttttaatattttctatggatttttgtactttttgtaacaatttagattgtctttccacagtctttaaaaaaatctgttgcatttcttgttttgttgcaagatcagaaatatccgagctattttcattttcagaaagtctttttcttgtttcagaaatggataaaataagatcttttttttgttggcataaaattttttcaaaaaattcatattgttttttattcatatatgaatcttcagacatatttaataattcagtttttgtcagcattaatattcttaatttaaaaaaaatataaaatttagcagatatttataaaaaataaaaatatctttaataaaaaatttaaatattaatttattttgattattaatttttattatttatttttatttttataaaaaataactataacaccgaataaaataattatgcctcctaataaattcttccatgatggtattttttttaaaaaaatccattcaaaaattatagataaaaaaggcacaaaatataaagaatttgctactactcttctttgaagatgatttaaacaaaaactccataaagtgtaagctaatgcaccaggaccaattccaagtaaaatgatagatattatttcttttcttggagcatagtatatctcttttattgcaataggagcagaaaaagacatcgcaatagttgcaaaccaaatacaccatgaagttatctctaaaggagataatttttttaaaagtggtttttgcattatagtataaaaagcaccacacaatgcagaaagacataagtatattatgccataattaatagatttagattgaataaagatcatagcaattcctaccaaagaaataactatacctatccaccccatagtattaattttttcatttaaaaagaaaaaggttattatagaaacaaataccggtataagactaataataaaactagttatggttggatctactgttttttctcctaaattaattaatatagtatacattccaataccaatacttccggttattaatagtaaaaatatatcgtattgttgaagaatatattttttaggaattaagaaaaaataccatggaaaaataaataaagatgcaaaaaagaatcgaagaaatcctatagattctggatgaaaatattttaatgtatctttaattcccacataagagagagaccacataattataacacaaactaaagcaatataaactattatatttttaaaaaatagaaatatcattttacgaattatattaaaaaaattttttaaatcatgcataataaaaatatatttttcaagaaattaatagattaaaaaataaattgataaaaatattatattgattataaactattataatttaaatactgtctttaataatgttaatttaagtatggatgtgaaataaaattgaaaaatgatattatagtttttgatgtttctaatttattttatatttctgcttatagattgcaaaaaaaaaacattaaaaacaataattataatataaatacaatttatagtaatactattcaatttatgagaaaattatattatttttttaaatctaaacatataatatttgcatgtgatagcacccaatattattggcgaagtaaatatttttctgaatataaaaaaaatagaaaaatgacaactttaagaaaaaatgtaagaaactcaataaaattttttaaagaaaaaaattttaaattatgtattgaagttcctggttgtgaagcagatgatattatttattgtttgataaattataaaattcataataatataattattgttagttctgatagagattttatacaattgcaatctacaagagtacgattatttaatccgcatacatataaatttcgtaaaattcctgaaaaattagaatatgagttatttataaaatgtatacgaggagatgtttctgataatatcccatctgcttatccatatgtaagagaatctctaataaaggaagcatactataatccatataaattttttatttttatgaaaaaaaaattatctgataatattgcagtatacaaaaaatatcaaagaaatcgattattaatcgatatgaaatttttaccaaaaaaatatatatcattgattaaaatattgatagataaattatctttaatagaagagtaattataatgttcattacaggaaaaatatctaaaatagaaaataaaattgatgaatttggtaaaatagattactttctttttttggatgaaaaaaaaatttttcttaacaatcttctcggaaaatatatttcattagaacacataaaaaatttaattttttgtataggatgccaaaaaaaaatgaaagcatggtatagaaataattattgttttttatgcaataaaaaactagctatatgtgatatttgtataataaaaccagaaaaatgccattttcatttaaatacctgtcgtgaaccagaatggggatggaaatattgtatgaatatacattatgtttatctttctataacttcgggagccaaaataggcattacaaaaaaaaaaaatttaatatttcgatggatcaatcaaggtgctatccaaggattactcatagctaaatgtttaaatcgtagaattgctggattatacgaaaattatttaaccaaatatattgcagataaaactaattggagaaaaatgttatctaacattattaatttttctgatttaaaagaaatcagagatcaaataatatggcgaagccaaaaatctttatttttgcaaaaattttttaatgaaaaatctatattaatattaaaaaatgaaaaaatacaaaatttgatttatccaattataaattatcctgaaaaaattcagttatttcattttaaaaaaaaattaaaaatttctggcattttaacaggaatcaaaggacaatatttattatttaataatactgttataaatttaagaaaacatttaggatataaaattcatttttaccaaaattctctataaggaatatatgcaaaaaaaaatgaaaaacggcgatactatacataaagaagattttatacaatctattcataatgcattgcaatttatttcttactatcaccctatagattttcttaaatctatggtaaaagcttataaaatggaaaaatccaaacctgctaaagctgctataggacaaattttagaaaattctcgtctttgtgcaattggacatagacctatatgccaagatactggcatagtttgcgcttttgttaaagtaggcattcatatgaaatggaatgataacaataatatgagcattgaagaaatgataaatgaaggaacaagaagagcatattctgacaatactaaccctcttcgcgcatctattgttaaaaatcctcttgaagatcgaaaaaatactaaagacaatacgcctgcaatagttcatatttctacaaaaaactcttcagatatagatgttgcaatatctgccaaaggaggaggatctgaatttaaatctcaatttactgtattaaatccttatgatagtttggtagattgggtaattcaaatgattcctaaaatgggtgctggatggtgtcctcctggaatattaggaattggcataggaggaacttctgaaaaagctatgatacttgctaaagagtcattgaatcaaaatattgatattcataaaattatgaaatatggtcctaaaacatatatagaaaaattacgattagaaatttatgaaaaagttaataaactaggtattggcgctcaaggattagggggtgttactacagtattagatgtaaaaattaaaaaatttccaacacatgctgcttgtttgccggtagcaatgattcctaattgtgcggctacaaggcatataagttttaatttaaaaaaaacaggagaagtagcatgttttactccaccatcaatttctcattggcctaaaattaattggaaaaaagattattctatgataaaaaaagttaacatttctaaattgaaaaaaaatgaaattttatcttggaaagtaggagaaaatttattgctttctggcaaactccttacaggaagagatgcaatacataaaaaaatagaaaatatcataaaaaataaaggaaatttacctgttaatttccaaggtcgttttatttactatgtgggtccagtagaaaaaacaaataacgaaatcattggtccatctggacctactaccgcgaaaagaatggataaatacacaaagtgtatgttatctgaaaaagttggaattttaggtatgataggaaaagcagaaagaagtgatcaaacaataagaatattaaaaaaacataaggttgtttatttaattgctgttggtggtgcagcatatttaatttctaaatcaattagatcagcaaatataattgcttttaaggaattaggaatggaagctatttatgaatttgaagttgttgatatgccggtaatagttgcagtagattcttcgggaaattcaattcataaaaatggtcctgctttttggaagaaagaattaaagcacattccaatttatccatataaataaatttattttataatatttgcaatatttatatattttttttgatttttgacatcctgtatttttttccatccaattccatatattacttcaatagttgctgtatatggagaatcaattaatttatttttaggatatgattgataaaattttaataattgattaggtgtatagaatttagaaaaactaaattttatacaatttgttagacctaatgctttaatgtctttaagcaaatatttaggatgtaaataatatattttatatttttcagtatttattacaatatttttataacctatattagataatatatttcctatgtcacaaatacctaccataggatgtatatgtatataattatcaattttatcccaagctaatttaagttcttgaagtgttttgggaccaaaagaagaaaataaaaataatccatgattttttaatagagaatatatttctacgaacaattcttttaaattactattataccaatgaatatgaagattagatacaatcatatctaaagattctttaggaaaaggcattttatgagaatatgatactaaaatattttgaatattttttttttttgcaatttttaatcgtttttctgaaagatctaaattaaatatcttttctatagagaattttttatacatttctaatgtaaaatttcctgtattagctcctaaattaagaatattatttggtttataattaaaaaaaataagattttttaaaagatttgattcaatttttttaaaaaaattttcatatttttcatatgtatttgcagttttatttagattatatttaactttactaaaatttatattcaaaattttaagaaatttcatacattaaatgtttagtatatactatatataaaattaatacctaaagcattatttatttcaaataaatataagtatatttttctatttatttttattctaatttgcatttcttgttcgtgatttaataatccaaatccatatgttataaaaaaattagatgttatattttttttcataaataaagctaaattatttttaaataaagataaaaaatatgaattagaatttacattactattattttgaattaaaagattatttattttacctaaagtaattaggtcaatatttaaaaaattttgtattaatttaaaaaaattatttttattaagaaatacagaaattaaagataataataattgatttttattttgtaatttttgtattgttgtatctaaaaaaatataagagattatatcttcttgtgtctttcttggataagaagaaaaatatattttgatattatcaatttttcctaatatatgtaaagtaataataccatctgttaataaattatcatttatatttttatatatatattctcctaatatatttattgttggattttgtaaaatattatccttataagtaatagtagcatatttaattgaaaattttttattatagatttgataaaatccattttttataaataaaattccaaaaagaaaaatagaatttttcttttgattataatcattatatatttttaaatttccttttaattttccttttaaacctgatccatataccgtcatatttttaatatttaaagaaatattttttatatataaaaataattttttatttttaatatttttattattaattaatattatgtctttgttatataaattttcttttattttatttatatttatataaccttgagaaagtattatgtttccaaagatttctaaggattttttaaaaaaattatataataattctatattagaattgattttgcttgtaaataataaaggttgagaaatatatatatcttcttttttataaaaagaaatatggattgtattccatgcaaaaataattttaaaaaaaatatttccattaataatatatgtatttccgtatactatacggttatatagaatactattaaaatcgaatttatctaaattaacaatcaatctttctttgtgcgaagaaaaatataaattttcaatttttataaattgattaaaatatttaaaataagaaattaaaataaaattattattttcaatatataattttgaatttttattcttatttatattatttaatataaataatatttttacttttggaaaatatgataatatttcttctaaattagaaatactaatttttaaattaatagcccatttttttggttttttaaaaaaatacatacatgtatgagaaataaatacattttttttatttaaaaaatatatagaaaatggttttacaataattttatttttatccaatgtaaataaaattttaccacgagaacaacattttttgttatgaattatattcacatataatattccattatagatagaatttatacgattaacaatttttatttttccaaaaaatttttcttttttttgtggattactattaaaaaataaatttatcaaaaatattttatgatgataaatttgaatttttccatatatggtttctatatgaaaaatatttttatagattttttggattgaaaaattttctatacgaatattatagtttataaattttttaatatttttcattaaaaaagaaaaatcattctgatttttatgattatattgaatagaataaattgagattttttttatatcaaaattttgtgaaaaaattaatttttttattgaccacattatatgtactttttttaatattatttttttttttgaatttttaatttttatctctatttttggaataaatatatttgtaatttttccattaattttattaggaacaaaatatatattatgagcttgaaagaaaggataaaaaatttttaatgtccattgacatcctatattactatttagtatataaaaaaaaatacaaaatataaaaaaaaatatcattattatccatttgataattcgcattatatagtttttcctatactaaaatcaattctccattttttataaatattatttaaaataggtctagaaaaataaacatggatatttcctaaaatagttttccaatttatacccatacctattgcttttgcaaaatataaatttttccaataattaaaactattgcctgcattataaaatatagaaatattaacattagtattaatataatataaaaaagatatttttcctataatcatataatgtccaccaattaacccatgatttttatctattggagataatgacttatatggatatccaagtaaactatttactcctccaacataaaagcgaaattcaggaggaagtaaattaaaactatttgttataatagtacctattattacattccattcaattccgtaatgagcatatttaatttttaatttcatatccagaatatttcttaaaaaattatatggggataaaatattttttaatgatcctattattgataaatgagtaaaaaatataaatgtacaaaaattgttgtatttttgttttttttttatatctatatttaaaaaacttgaaaaaaaatttgtattaattttttttttagaaatatttatagtagatttactaataatttcagacaatccaaaattaaatgataaaaaatcaaaaattttattaaaatatgttattttaatattattttcaaatgcagtatatggaataatttttaaaaaaaattgatttatatttacagaaatatagttatataatggactatctaatggatagatatacttaaacgttagatttggatgaaatatggatatagttccataaagtttaaagtatatgccggtattagtaatatgatatacattccattcaaaataccctgttattcctttattttttttatatcctattcctattaataaattttgcggttttttagctgtaagatttactattacagatacattttttgtttttttattaataatagtttgaatattaacatcatcaaaatatattgtattatttaattgattttgtaatttatgtacttttttaaaagtaaatttttctctaaatttatatggtatatatttttttaaaaaatgtttttgaaaaaaaaaatttttttgtttaaaaatagtatttgcaaaatagtattgatctccagtcaaaagttctatataaataaatgctttgtgtttttttatatctatttttattatgtgttttgttaaaaaagcttgcaaaaatccttcttcttttgcgacttttaaaatttttttttttaaatcttgataatatttaacaacaaatttagttcctattatatctttgtaagagtttaaaatattttttaaatttttatttgattttcctgaaccttttattttaattgataatttatcaattaaaataggtttccctggatatattttatatattagtttatatttttcatttttctttttttgcataaaattaataatcttgctttcataatatccttctgattttaaaatactaataattatattttgatttttaatcatattttttttaaatagcaaattagattgattattttctaatttaaatttttttatatccagattagaatatattttatataatagattttgtggaattcctaaaatttttatttgaattttgctttgagcatttaaaaaatatatatttatgataaagaaaattaagatttttaataaaaaaattccatataaatttattgcatgattaaacttattaaaaaatataatattgattttcaaaagaaattaatgattattaaataattaaacattctaaattagaaatgaaatataaaaaacataaaatatttaattatttaaatacagaaaaaaatatttatataaaggatattgtatttattttgtttattacaatttctattttttttataactacaatattttcctataatcctgcagatcctatatatttaaataattcaaattctaaaattattgtccataatttaaatggggtaataggagcatatttggcaaataaaatatttttattatttggtaatattagttattttttaccattattttttttatatactaatttttttatatatcaatttttttttctaaaaaaaaatattaatatatatttgatatgtataaaaattattggcgctatttttgtagttgcttctagcagtggcattagctattttttattaaaattttataattgtaatatttattctgaaaaaattggaggaattttaggaaaaaatataatacatattataaatccatatttaaatagtatgggaacaatattgttattgcttttattattatttataggaattacattattcataggtcttttttggttaaatattattaaaacaataatatcattaacaatatttttttttatatttctatttaaaaatttattgaaaataaaaaatttttttttaaaaaaaagaacaaaaaacccaatttatttttttttgaaaaaaaaaataaaaaataaaagattaaaaaaaaataatttctataaaattattccatccatagaattattagatgaaccaaaaaaaagatctgattttacttttttaaacaatgcaaaatttatgtcttcatttttagaaaaaaaaattttagaatttggttttgtagtaaaagttattaatatatatgtaggtcctattataacaagatatgaattaaaaataccccctggttttaaaactaataaaataattaatttatctactgatattgcaagatccttatccgttgtaaatattagatttattgctatcataccaggaaaaccatatttaggactagaaattcccaataaaaaaaaacatgtagttcaactaaaggaagtattgtcttccgaggaatttttatcacatccatcatcattagcaatgggattaggattagatgtttctggaattcctaaaatagctgatttatctaaaatgcctcatcttttaattgcaggaacaacaggttcaggaaagtcaatgtttttaaatgcaatattacttagcatgcttttaaaaaataatgctaaaaaattacaattaatcatgattgatcctaaaatattagaattttctatttatcaaaatatacctcatcttctttcgccaataattactaaaacagaaaaagctaataatatacttttttggtccgtaaaagaaatgaatagaagatacaaaataatggcgaaaataggtattaaaaatattttagaaatgcataataatataaaaaataaaaaaaatattaatgataataaaaaagaaatttttccatatattattatatttattgatgaattttcagatttaatttctgaaaataaacaaattgaaaaatatataattcaattatcacaaaaggcacgagcatctggcattcatttaatcttatccacgcaacgcccttcagttaatattattacaggagtaataaaagctaatatttccaccagaatatcattccaagtttcttctaaaattgactctaaaattattttagatcaacaaggcgctgaaagattattaggcaatggagatatgttatatctgaaatctggcaaaactccaattcgtattcatggaccatttgtatcaaatcaagaaataaagaaaatagttaacttttttaaaaaagttaattattaaatataaatttaaggggaaaatatatattttttttatatctaaattatttctttatttcacataataattttttttgtattttatataaatagttccatgccattttatgggtaaatttatcgagatttaaagaacaaatactttgttctaaaaaatatatatattttgaatgtaaataaggatttaaaatagtattggtaaattttggatttattattttttcattttgaaattttagattttgtaatttttttctggctctttttataatatttttattaaaacctgctaattctgcaactttaattccataactctcattaattgatccttgttttacttcatataaaaatacaatcttattaagatattctattgtttttaagtgatagtttttaattgtttttacttcttctgaaattttagataattcaaaataatgagtagaaaataaagtataactactgatctttgataatttctcgcaacaagcccatgctaatgataatccatcaaaagtgcttgtaccccttcctatttcatcaattaataccagactatactgggttgcatgttttaatatattagctgtttcttgcatttctatcataaatgtagattttccttggctcaaatcatctgaagatccaattcgagtaaaaattttatctattcttccaatttcagctttttttgcgggcacaaaactcccacaatatgctaatattacgattagtgctgtttgtcgcatataagttgattttccacccatattagctcctgtaataatcattaatttgcaatctttattcatatttatactatttggaataaatggcttatccataacttgttcaacaacaggatgccttccataagaaatattaataatttttttttgtgttaatataggcttgcaaaattttagagaaactgctcgctcagcaaaacaagataaaacatctaaaattgcaattttttttgataaattttgtaaaataaaaaaccattgattaagattttgaataatcttaaaatacaaatttttttcttttataataatgcgttcttgtgtactaattattttatcttcaatttcttttaatttttttgtaataaatctattactgttttttaatgtttgttgttgaatataatgagatggtacatatttagattgtattttactaatttcaatataatacccactaatctttgtataattaattttaagagttttaatacctgtagtttttctttctttttcttcaaaagaaataagacaatttcgaaattttttaactttttttcgaagatcatctaattctaaattatatcctttaagaataactcctccgtcttgaattgatataggaggatgttctgcaatagcagaatttagtaaatctaatatttttttttggggatataaatctttagatattttttttaaaaaataagaattacatgtagatgtaatcttaagaagatcaggaattttttttaatgatgagcgaagagatgtaagatctcttggtttagctgaatatgaagaaattcttccattaactctttcaatatctccaatgaattttaatatatatgaaatttcttgaaaacatgttttttttattatttcttctatacttaattgtcgatatctaatatttttatatgattttattggatgagatatccaacgttttatacatcttttccccatgggtgtaacagtggtatctattatttttaataaagtattttttttagaattttcataattaatcaattctaaattttttctactattttcatctattatgagaaaattatttaattgaatatgttttacatttttaatatgagaaaaattactttttcgatttttttgcaaatatttaaacaatgctccagaagctatcatagctaatggtaaataatttgtatgtaatggattgaaaaaatcacaatttttaaattttttttgcaaaaaatttttagattctattttagaaaaataataatcaggaactttttttatattatatctttttatattttctagattctctttttctgaaattaaaatttcttttggattcaatcgaaaaaattcattttttattttttctataccaccaatattttctataatttcaaaacgagatgtactcatttctataatggataatccaaattttttttttgattgatataatgaacataatatacattcttctgaaggatctagtaaagattcttctacgattgttccaggagtaataattttaactacttcacgttctataagttttttttctgttttaggtttttctatttgttcgcaaatagcaattgatttccctatttttatcaatttagaaagataaatatcaaccgtacggcatggaatacctgccataggaacaggtttgcctttagatttcccccgggtagttaatgtaatatctaagatttcagatgctattttagcatcttcataaaaaagttcataaaaatcacccatcctatagaacaatagaatatttggataattttttttaatagataaatattgttttatcataggagtatgattatcttctattaaaaaattagaataagatatcacgatgaattattttaaaatagtaaaaaaatatcgatattttatcgaaaaaatattaacaagtctaagatttatatttattttaatattaattttttttttaaatatttcttttgcaaatcgaattattactcttgcacctaatattactgaattagtatataaattaggatctggaaaagatatagtcggagtaagtagttatagtgattttccaaaatcagcaaaattcttacctatagtatcaaattacacatatattgatattgaaaaaatattatatttacatccaaaattaattattggagaattaagtaatggaaaaaatattcaatggaataaagaatttaaaaaatttaaaatctcttctttttggttatctatcaataaaatttctgatatttctcaaatgttttcaaaacttggaaagttactaaaaaaagaaaacacagcaaaaatcaaagaaaaatatataaaaaatatttttgataaaataattttatataaaagaagaaaaaaagataaaattcctaaagttttattacaaatatcatatcaaccaatttttgttgcaagtggaaatagtattcaaacaaaaataatttgtttttgcggaggaaacaatatttattataaaaaaaaaaaattttttattcctattgaaattgaagatgttttgaaaaaaaatccagatatattgtttgtaatgaataattttcaaaaaaaattttgggagaaaaaatggccaattttaaatgcagtaaaaaaaaatcatatttatattttacatccaaattggatattaagatcaggccctagattgatttatggtttaaaagaaatatgtacatttattaattctttctataagaaaagttaggaagtatgcaaatgaattttagtttttccaggataatgaaataattttattatttggttcttactattttttatcaaatataatccattatttgcaatccccattccaattccttcgatagtatgatgtgaagatgtaaatataattttttttttataaaaaaaatcaaattttttccattcatttaataaaaaaaataattcttgatatttaaaatttcctaaatcagatattagctgattgattaaatcagcaataaaactatttctatctagaattttaccggtttcttcaaaaaatgaggtactattttgtaagattttctttttaagaaaatttgataaatatccatttattccaattccaattatacattttatcattttatttttatcaaaatatcgttctataagaatacctccaattttttgatcattataaaatatatcatttggccatttaattttaatatattttccaactttatatttttgtagaatttttacacttactattgctacaagaatatttaaaatagatattttagaaagcatagaatatttaaaggtccataaaatggatatatatatattataaccaaaaggtgattgccatattttatatctagatcctatcccaaaagtttgcatttcacttatgcatattccatacttttttttattcatattcattattttatatataattttattagtagaacttacacaatcataacatataatattcttaataaaatttaatgatttcatatttaatttattcataataactttttggtttaaaggaaaataaggacctggaaaaacataaattttatttaaaataatttttatatcaatagccataaatgtttgcatatattttatatattttaaaagagtaaatttactaattttttttttttttaaaacttccgaaactaagattttttgtttttgacttataaaaattaatatttcttttaaaattgttaatttttttaaattaatcattgattttttatatataaaataaaaaatatattatgaattaaaaaattcataaactataatagttttttcttaatattttcgatagaatttaatttaattttagaaattctaatgttagaaattttatgttgaaaaaaatatttttatttatcaaaatttctttatttttaatttgttttcaaatctattgtaaagaaattattaatataaaaaaaattaaaatagaaggattgcaaacaattaaattgcaaaatattatttcaaaaattccagattctataaatagaaatttttctttagaaaagtctgatcaaataataaaaaatttatataacactaaatatttttctaatattataatttttttaaaaaaaaaaaacattcttattattaaagtaaaagaactacctattattcagaaaattaatattaaaggtaatacaaaaatttcaactttttacttaaaaaaattttttaaaacattcaatataacacctggaaatatattaaatccaaacaaattatcgcaaataaaaagattgttattagtaatatactctcaaaaaaaattgtatggaactcaagtttttattaaaaaaatattaaaatcaaaaaatcaaataatgataaccttttttgtaaaagaaggaaaaattaaacatatacaatctatcaattttataggaaataattttatttcatcaaagattttaaaggatcaaatggttttacaagaatcaggaatattgagtttttttaataaaaaagatatttattctaatgaattattaaatttttctataaaaaatatctatcaatattatatgaatcatggttatttagattttaatcttctttcgataaaagtattaaatttaaaaaataataaaaatgttataatacaaatacatgtattagaaggagaaaaatatatttttgataattatactattcaaggtgacattgtttttacaaaacaaagaattaaaaaaattataaaaataaaaaagggagatattttttctagagaaaaaattattcaatcaataaaattgattactagtgcattaggtgatataggatatacttttccagaaataaatataatttctaaaattgataaaaaaaaaaaaatagttaggataatatttaatattaaaaaaggaaaaagactttatattagatatatttcttttataggaaataaaataactaatgataatgttttgcgaaaacaaatacatattttagaaggtgaaatctttaatgaaaaatatattaaatattctgaagaaaatattcaaaaaacatatccttttattataaatgtaaaacataaaataaaaaaagtaaaaaatacattatcaaaaattgatatagatttttatgttaaagaaaaaaatgctaatacagtcaatgctaatttaggtttttctaatttagaaggacttataatcggagggaatattaatattccaaatttatttggtacaggtaatactattaatttaggtggatcttttagcaaaccaataaaaagtttagatttttcttatattgaaccatattctgtcatgggaataaaaaaatctataaatattcaaattgttaatattaatagtaggcaaaaaataattaattttgctagaaatttatataaagcyaatatagaatatgctatgccaataaataataatttttatattagyacagatgttggaattagtcacattgtattattaaataataatagtgaatcagaaactattaaaaaattttttatagaatatggaaaaaaatttacaaactataacttaggattatctattatatataattcaacaaacaagttttggtttccaaataaaggcacaaaattaaatttatcttatcatttttctatgcctggaagtactattttatggtacaaaatatatttatctaatgtgtattattttttaataaaaaaagattatgttttttttatagaaaattatataaaatatggaagtaattatggatttcaaaaaaaagatggtatatttccaatatatgataatttttttggtggaggatgggatttagttcgaggttatgcaactaacagtttaggtcctaaagatactattattgataaaaaaggaaatataaaaatgggagatcccatagggggaaatttatccattgtttctagattaaatttatgttttccagttccttttattaaagattcttctaatatgagaatgggtgtttttttagatgcaggaaatatttatagtacaaaatatatttctactatatgggacaaagatcatcaacctaaaatgccaaatttaaataatttaaaatattcttttggagtttttatacaatggatatcaccatttggtcttttatctttaagttttgcggatccattcaatgctaaaaaagaagattctatacaatatatacaattttctataggggttccatttcaataaattaaaattaaggagaataaaatgaaaaaaatatatactatttttacatcaatatttatatcaacaatatgtttttcaggttatggatggggaaatacttcttcaatgtcttataaaattggtgttgtagattatttgtcagtttttcaaaacgtaccacaagggaaaataacacttgataaattaaaaaatagtttagaacctaaaattaataaattaaaagaagagagtgattctttatcattaaaaatgaaaaatttaaaaaaaaatgcttttacattatctaaaaaagaacatgaattgcaagtactatctattaataatgaaaaaaagaaatttcaaaaaaaagtaattcaacttcgtgaaaatgaaattaaaaaggaacgttcagctgctaaaaattttgaaataagtatgcaaaaagctattaatcagatagtaaaatctgaaaaatatactattattttaaataaacaagctgttccttatttttctcataatttagacattaccaatcaagttatagatataatgaaaaaaatataatttttttttaaaaaaaataaaatatgatatttaaaaaaaaacaaatatcaaaaaacataaattcagctactaattttttaaaaatttattagtagctggttccctttcaatatattttaaaaaagattcagtattatgttaaaaaaatatttaatggaaaatataaaaaaatttcttataaaaatgaattgtaaagatcgtattagcaatttgtataaattattcgacaaactatttcaaaataaaaaaaaatgaaattaaatattaattatattttaagtttcctacctcatcgttatccatttattatggtagatcgtgttttaaatttagttcccaaaaaatatataaaaacattaaaaaatattactgttaatgagcctttttttcagggacattttccgtcaaatcctgtcatgccaggagttttgcaattagaatctattgcccaatcattaggaatattaatatatcatgattttcataaaaaaaataaacctaaaaaaggagatatattttattttattggtattaataacactcgttttaaaaaacctgttattcctggtgatcaattaattatggatattacattaaaaaaacaaaaacaaagaatttatatagcagaaggaatagcaaaagttgaagaaagtatttcttgtaaaactgaaattatgatcttttataaagaaggatattaaaaatatttagtattattgataaaaaattgggagaaataatttctcccaatttttactgatatcaagttttttaatctctgctactattggtagaaaacatacctaatagttgcaatatagtcagaaaaatattaattaatgaaacaaacaaagttacagtagcaactatataattcctttcgcctccacgcacaatttcgttggtctgatacataattaatccacctgatattaaagaaaataatacagaaataaccatttgtagcattggaattttaaaaaaaataacattaattaatgaagatataaaagcaataattataccaactgtaagaaatctactccaattagaaaaattataatctgtattcatagatatagttgaaagaactaaaaatattaatccggtagaacctaaagacatcataattagttcactaccatttgtaaaatttttaatataaaaatttaataacggaccaatgtaccatcctataaaaccagtatacaaaaatgtaaaaaaaatgccccatatactattttttgttgcctgtaataaaaaaggaaatccaatcattattattaatgttaaccaaatattagtaggagaagaattgctaataatagataaaccagctataaatgaactaaacaataatgtcaaagataacaatatataagtattttttaataccttattagttgctatagaagaaaacttttccattgtatgttgtttttgcattttactataaaatctctttttaatatctaaatgttaatagaaatattctctcttagaaaatacaaaaatgcaaattattatttgtaataattttatgtaattaaagaaaaacattgaatggaaaaacaaataaatcctaaaaataaaaaaatacctattatacgatttaaaaaaaattttttatataaagttaatatataagttaataaataactaattccgctaataaatagccatataatttcaaaataatcattattatggtttgatgttaatgtataaaaaatagaaggtaatccaatacataaaaaaaaattagtaatattgctacctaaaatattactaaaaattaattctatatttccttttcttgcagaaaaaatagatatagatatttctggaagagaagtccctaaagatgccgtagtcataattaatgcttcactttttatgcccataattttagacaaattaaaaatactattaataataaaatgagaagaaaaaataagtattattaaagacataatcaataaaactatagaatagtataatgaaaaaaatggaatttttttttgtatattatatttttttttaataggtattgattttacaaaaatccaataaatattaattattcctaatacaagaattaatatactataccaactgtgaaaattattcataataattccaattattaacaataatattgataatatgaatattattatattggaataatgcaacggattaaatatcctattttttttgttttttataaaaaacaaacttattcctaaccctaataagatatttattatattacttccaacaacattggggataataatagatgaatgatttgtaaaaactgaatataaagatacaactatttctggaatagaactaccaaatcctacaacaaaaagtcctattaaccaagaagagcaattgaaataatttgtaattaattgtgttgcatataaaaaccattttgtgctttgaaaaagaaaaaatatacctaacaaaaaaagaaatacatctaacaattttaaagaaatttgatatattaaaaatgataaaatatcacattcttaaaaattaaaaataaatttttgttaatatttttgcaatgttttgtcaattttatcaatccattgcaaaataccaccttttaaattaaaaatattttgtaatccattttgtaaaatcattttaacaactaatgagcttcttataccggatcgacaataaataataattttattctttttatttaaattttttaaatattttagtatttgactttctggaatccaaatatcctctttaattttgcaaatctttctttcatattcttctcgaatatcaataagttttatattttttctacctattaattttgataatttaaatacattaatttcagggattttaatattatttttgatagaatttttatataaaattatattattatcattatttccacaatgtgttttacaacatttagaatttttaaatattttatattgaaaaaaattcatttttagaaaatctataacaagtaaaaatccacttaataaaattcctttgtttaaaataattttaattgtttcaatagcttgtaagtttcctaaaatacctggaactactcctaaaactccatcactattacatgtatgcgtttcttcttgatttgatgtaattggaaaaagacattcataacatggacctttattataattaaaaatagataattgagcagagaactgaaagatacttgcagaaactaatggaatatttcgcaaccgacaaattttatttatagtatactttgctaaaaaattatctgttgcatcaattacaacattataattttttaaaattaattgagcagcatttttttctgtaattttttttttttatagataaaatgctaataaaagaatttcttcttgaacaaaattttgcagctattactgccttttcttttccaatatctttttctttataaattatttgtctttgtaaattagataactcaatataatcataatctataattactattttcccaacacccattgaagtaagatattgcaatgcagaacatccaagacctcctgcgccgatacataaaatagtactttgtgatattttcttttgtccttttaaaccaataattggaaaatgtcttaaatatctattgtaataatttttattagacacagatctcattttgtgaaacataattaaattaataattcttttttattatttaacatattttaattttaaattaaaaaataaattatatatatttgaaatatataatattattatacattatatataatatttaattaaaaaataagatatttacaatttaaagatgaatacttatactaaataatacatagtccaatttatattggaattaaagaaaattagggcctgtagctcagttggttagagcagtggactcataatccattggtcccaggttcaagtcctggtaggcccaccaaactttcatattttgtttttattgagcaatttattttcttttccagaaaaaattttttttatatttttatagtgtcttaaaaagattatagaaaataaaaaagttaatggaattaaataatatatatataatttaaaaaaaatagcaaatattaatgtaaaaaatattgctattatagatgctaatgaagagtaattaaatagaattaatataaaaatccatgttaatataaaaattattcctaatatataattaagagccagcaatgttcccaaacatgtagcaacacccttgccacctttaaatttccaaaagattggaaatatatgcccaagaacagctgtcaatcctatataccataacatggtatcatttaaattgaaatattgaccgataacaattggtataatagattttatacaatcacctaagaatgtatatatagttatagaaaatttattagttaaacgaaaaatatttgtagcaccaggatttccagatcctatcgatctaggagatggaagctttaaaaccctgcaaataataattgcactatttaatgaacctaataaataagtcaataggataaatattaaaaataagagatttaaatttataattgtaccttgttgtaaatgaactaaatcttttattagtcgataattatacatgttgcaatttataattgcaagtttaagatattcttaaaaaaacatctgtaaaattaaatatttttaaattttggtggataaaattttgaaatttatttggggaataaataatttaaatattatggcaaaatcaacaataattactattggttcttttgatggtatgcataaaggccatcaatgtttgattgacaatgttgttttattatcccaaaaaaaaaaattacctagcatggttattatttttgaaccacaaccaaaagaatatttttcaaaaaattctacaaattccaggataatgacattaagagataaattaatttttttaaaaaaaaaaaaaattgattatattttgtgtattcgttttaatttaaaatttttaaaaaaaagtcctgaggattttgtaaatgaaatattaatacaaaaaatgaaatgtagatatcttatagttggacgtgactttcaatttggttttaaaagaaaaggaaatatagattttttaaaaaaattgaaaaattttacaattaaaattgtaaaaactcaatatataaataaaaaacgtataagtagtagttggttaagagaatgtttattaaattctaaatttaatctagcatcaaaactacttggtagaaattatattattacaggaaaaatttttcatggtataaaattaggtaggaaattaggattccccactattaatattaatctttctaaaaagatggttttatcaggaatttattatgttcaggtacaaggaataaaaaaatataaaaaaatacagggcattgctagcataggcaatagacctatgataaaaaataatgatttattattagaagtttatttattagattttaaagatcaatgttatggaaaattggttagtgtaatatttttgcaaaaaatacgagatgaaaaaaaatttgtaagttttaaatctatgatacaccaaatgcatatagatttaaaatatgcaaattatttaaaaaatttttacatagatatatgataattgatatactaataaaaaattttcaatttttaattaaaataacagaaatgtctaattataaaaaaactttgaatttaccatatacagattttccaatgaaagctaatttatcttttaaagaattagattttttaaaggattgggaaaaggaaaatttgtaccaactgataagacaatctagaagaaaagaaaaaaaatatattctccatgatggtccgccttatgcaaatggagacattcatattggacatgctatcaataaaattttaaaagatattattattaaatataaaattttagatggatatgatgcaccttatataccgggatgggattgccatggtttaccaattgaattacaagtagaaaaaaaatatggtaaatctaaaaataagtttatggataatatatttcgtaagaaatgtcgaatttatgcacaaagtcaagttgataaacaaatgaaaagttttaaaagattaggaattttagcagattggaaaaacgcatatttgactatgtcatatcaatatgagtctaaggttttatatattttagctagtatatttgagaaagggtatattaaaaaaggttttaaacctgtacattggtgtacaaaatgtgaatctgctttagcagaagccgaagtagaatatcaagaaaaaaattctgattctatttatgtaaaattttatataaaatctataaaaaaaatttcccaaatttttaaaaaaaatattgaaatagctagtgccatagtatggactactactccttggactctttcggcaaatttagcagtagcaattaatgctgatattaattatgtcttaatagatatccaaaaaaaatctgaaaaatttattatagcagaaaatttagtaaaatcttttatacaattaactaaatgtagtagttttttaatattagcaaaatgcaaaggatatttattagaaaatattttactaaaacatccttttaattcatataatgtacctattattttaggaaaaaatattaaatgtgatataggaacaggattagtacatatagccccagcacatggagtagaagactataaaatttctttagaaaaaaaaattaaatttcaaaatatagttcaatataatggtgtttttttatctgatgtttttttagtaggaggtaaatattatagtgatgcaaattcaattattgttaattttttaaaaaaacataaaaaattatggtattatgaaaaatataaacatagttatccttattgttggagacataatataccattaatttttctttccactcctcaatggtttatcataatgaatgataaatttcttaccaacatagcaataaaagaaatagaaaaaatatcttggattcctaaatgggggtttaatcgtattaaaaaaatgattgaaaatcgtccagattggtgtatatctcgacaaagaaaatggggaactccattaccattatttatacataaaaaaactggaaatttacatccaaatacagttcaattaattcgaaaaatagctagtaaagttgctaaaggaggaattgaagcttggtttgaatcaaaaatatctgattttttagaaaaaaatgatcaaaaaaagtatgatattatttatgatacattagatatatggcttgattcaggtattagttttcattctgttttaatagaaaaaaaactaccattagctgatctatatttagagggatctgatcagtatagaggttggtttcatagttcattattgtctgctatagcaacaataggaactgctccatataaatcagtattgacacatggttttattattgatgaaaatggaaaaaaaatgtctaaatcattaggaaatatagtttctgtagaaaaattagttcaaaaatatggagctgatatattacgattatggactgcatcaattgactatcgaagtgatataattttttctgaaagtatgataaaatctaccattgatatttatcgaaaaataagaaatacaataagatttctattagcaaatttaaaggatttttgtcctgaatcagatctaattaatacagaagatatggttctaattgatcaatgggctatagaaaaaactctttcttttcaaaaagaaatacgcaaattgtatgattcttatctttttcatctagtcgtaaaaaaaatatatgaattttgttccttagatatgggagggttttatcttgatattataaaagatagacaatatacatgtaaaaaatttagtaaaattcgaagatcttgtcaaagtgtattatatcatatattagaagcaatggtgagatggataacgcctattcttagttttacagctaatgaaatatggaaaaaaattcctggcaaaagatcagtacaatgggtttttttagataaatggtataagaatctttctaagattcctattaacagtcatattcaaatgtatgaatgggatttttttataacattacgaaatatcgttaatcaagctattgaaaataaaagaaaaaaaaatgaaattggctcttcgctagatatacatgttattttatatttaaaaaaagaaaaaagaattttattaaagaaattaggaaaggaactaaaatttttattaattacatctgatgttaagataaaaaaatataattcctttgtaggagaaaaaactgcattagaagatataaaaattgatatttttatttctaattataaaaaatgcaaacgatgttggcatagagtcaaaaatattggatctaatatagattattatgatatttgtggacgttgtgtagaaaatctttttcaagatggagaaaaaagattttatgtataaaaaatcattatattggtttttttctattattatattatctttggatctttcaagtaaaatattagtaattttatttttagaaccttatacattacatcctgtgatcaaaaatttttttgtttttttttttaacatttaacacaggaattacttttagttttttttctggtaataatttttggatgcatattttattatcttttttaacaatttgtatactctttatattatctttaatcttaataagaaataaaaaaaatatttggattaatataggcatatctatgatattaggtggaggaacaggaaatttgattaatcgcattgccataggatccatagtagattttatgacatttctttataagggatatagtttttttatttttaatattgctgatatttttattactttaggtataatatttgtaatattaggattaataaataaaaaaaatagaaacgaaaaatattttaatttttatttatagaagatttaaatcttgatataacgcagatatttttacccaatctttaatatgtatagattctggtcttttaaaagttgaaatttttagtttttttataatatttttatttaaactattagttaataatttccttcttttttgaaaagctattttagtaacttttgaaagaatttctgtattcacttttccaaagggtgatatataataaggttttaagctaaaaaaaatagaatcaactttaggtataggaaaaaatttttttgcatttatatacaataatttttttattttgaaatggtattgcataataatgcttaaacgtccaaattttttattattaggtttagctattattctttccactatttctttttgaagcataaagtacatatcttgaatatatggaatatatttaattatatgtaatagcagtgatgatgtaatatgataaggtaaatttccaataattcgtattttttttttatgtaattttgaaaaattaaattttgtggcatcttcttgatataaatatatattttttttaaatttattagtaagttttttgcttaaattataatcaatttcaattgcaaatatattactacatttttttaataaatgttttgtcagttctccattacctggtcctatttcaagtatattttctcctgattttggattaaaaaaattaataatactatgaatagtatcggtatcttgtaaaaaaatttgactaaacattttatgtgaataaattttcattatatattatttaattaaaaaattagccaatttaatagattctaataaactatttatatttacatattttgttccaactaattttaatgcagtaccatgatcaactgaagttcgaataaatggcaaaccaagggttatattaattatttttccgaaagattttgcttttaatggagctataccttgatcgtgatacatggctaaaataatatcgtatttatttttgagatattcagaaaacatagtgtccgcagaaatcggtccaaatatattaaaatttttataattatttaatttatctatagtaggtctaataatagagttctcttctgatcctatatatccattttctcctatatgtggattaagtccacaaacgcctattctaggattggaaatactccaaatcttttttaaactataatgaataatagaaatttttttattcaaacttgtttttgtaatatatgatgaaacatcttttaatgctatatgagtagtttgtaaagcaattctatatatattatccgttaaaaccatgacaatatgttctacattacatagttttgcaataaattcactatgtccagaaaataatatgcctgattgattaataaaacctttatgcactggacaagtgaccattgcatcagctatttttttttggcagagtttgacagctttttttatacaggaaagaacataaattgaattatctggatttataataccaggatgaataacattaggacatacaataggatatatacatatttcatttgattttattgaggaaaaatcatttttttctttgattaaaatattttctcccaaaataacagcacgattatatattattttaggatcagcaatgaataataatttagcgttaattttttgatttgcatatattttcattaatttaattactatatcaggacctattccagaaggttctccaacacttataacaattttatgattttttttcattttaatatatattttaaattaaagaaggttttaaaattttaatataagaatcattttgtatttttatgttccattcttttaaagaattaaataattttttttgaaatatatcttttatagattgattttttaaaaaatttaaatcaacatcttttgattttatttttaataatttaataataatccaataattatttacctttaaaggttgactaatttctccaacctttaaattattaataatattaagtatttttttatttatattatttattgaaatccaataagtaatttttttaatttttttatttgaagataattttttattatattgtgatattgatttataaaaaattttttgtagttcttttccagaatcaattggaattatagttttttgtatataatattcattatataaatatgatataggatatattttctttttagcgattaattttaaaatatgaaatcctttgcctattttaaatggcccatatatacttcctatttgcattttatttaaaataggaataaaatcttgaggaaattcatctaattttttccaggacaaaaatcctcctgatgaagaatctatcgaatcagaatattttttagcagcattaaaaaatgaaatattattatttttaatattttcaaaaataaattttgatttatgatacaattgttttttattttcattagattgatttttagaaaagctaattaatatatgagatataagataaagattattattcggtatgcatttgttaattaaattttgtaaatataaatttatttcataaggttttataataattgtattgcttattttttgttctaatttaaacattaatatttgttttctaagattttctttatataaattataattaattccattttttttaattaaatttatcatatctatagaagatagattattttttttagcaatattttcaatcatatttttaatatctattttggttgctataatattttttgtaatagcaatctgtgtataaatttctaataaaattaaattttttaatatatttttttgtatcattaaaatattaattttattttttttgtgaaataaataatatgtttttattgcattatctaattgataactagtaataatattaccattaacaatagctgcaatttcatttactatttttgcatttttttcatctgtaatatttttttctatatttttagtatcatcttctataagaagattatcaaatgctaaagattttgtattatttataaaaacaaaaattgttaataataaaaaaatgattttttttttattaaaaataccactcatatgagtatatgatcctattttttacaattctataattagaataaatattttttttaaattattaaatatagaattatttataataaatataaatttttattttatataaaatattcaaaatattctacataatgattaatatcatattaaattattttaatttttttaaaagtttatatttttgtatgtctatcttaatataaagatataaagatataatgttatttatttgataataataaagtataaaatatttttataatatagttaatattattaatttataaataaaaatatttttattctctaaaaatagatgtttagatattttctgaatatactatattagtagtttttatctaaaataatataataatttcatatgcataaattaaatttaatattaaaatttttaaaaaattaaaatggttcataatttaatatgattgggaaaatattaggaggtttttttggttttttattatttggaacaataggttctttaataggtattgtatttggacatttttttgataaaaaccgttcaattcatattttatatagtaaaaaaaatatgaatattttttatagatctctttttagtacaataggaaaatattcaaaaatttttaaaatttttatagattttatgtttatagaacaaattataaaaaatattggcttaaattctatagaaaaaaaatatgcaataaaataccttgaaaaagggaaaaaagacgactttaatatttttgattttttaaatgaatttaaaaatatatttatacaaaatgggaagttacaaaaaacatttatagatattttattggaaatagcttttctaaatggaaatccttcttcagaggaaaaaaattttttattaaaaattgcaaaaaaaataggaattcatgaagaaaaatttcgagcaatatttttcactttttcttataaagaacaattccattctggatggaatttttattctgaatattattataataatgatcatggttctaaaccatataatgaaattaataaacatgaacttattgarcaagcttattctattttaggtatttcaccractaatgatatttatgaaataaaaaaaacttatcttaagttaatgaaacagcatcatcctgataaattaattgctaagggcttttctgaagaagctataaaaaaaacaactaaaaaggtacaaaaaattcgagaatcttatgagatacttaaaaaacattgtaaaaaataaatattatgcataaaaatattaaatataattctttttgtatttgtccatctatactttctgctaatttagctactttaggagaggatgtaaatcgtgttatattagctggagccgatagaattcatattgatgttatggataatcattatgttccaaatttaacatttggaccaattatatgtaaatctttgattaaatttggaataaaaattcctattgatatacatttaatggcaaaacctgtggaattattaattaagagatctattgaagcaggggcaaatggaattatatttcatcctgaatgctctcaaaatgttgataaaagtttagatctgattaaaagagcaaattgtcaatctgctcttgctataaatcctgctacttcattaaattctattatagattttttagataaatgtgataaaattgtattgatggcagtaaatcctggttttgaaaatcaaaaatttattccagagacgtttaataaaattaaaaaattaaaaattcttcttcaaaattttaaaaaatataaaaatattcctattgaaattgatggaggagtaaaatatcaaaatattaaaaaaattgctaattttggagtaaattcttttgttataggttctgaaatatttcataataaaaattatcatcatataatgaaaaaattgcgtaaaaaattagaaaattaatttatttataaataataaataaaattatatattttcagtatcttttttatttataatatttttttctaaatataattttttatttttttttaaaattttgtctatatttttgctaattttttttaaatgttttctattttcaaaaaatattaaaattaattcacaaaaaactttagataatatagtaccaattattattttgatagttcctaacaaaaaaagcaaaaaatttcctcttttatataagagacctatttctatattataagtatatccaaaagaatctataatatcattcattcctaatattatagaaataattacaaaaaatccaaaaataaaataaattattgatggtgttaaaattttattaaaacaataaaatttttttataaaatctttgaatttcattttaaatatttatttacttaaattactttgtattattatacattaaaattaattttatacaaaaggataacttttaatatttatgaaaataaaattttaatatttatatattttatatataatatgtaacaatagtcattattttagataaatatttcattaaagaacatataattgatggcaacttatattcttcaatatatgaagctttttttgcatgataaatttcatcatctttaattttttttaaaattttataacttatataatcttgtatatacaaaatttgttttatatgattatctagatgttgcacaacttgtttttctgtttcttgtataaaacctaaaataattttttttccaaaaaaagatgttaaaactcctatattaaaagaaaaaatatagaaaaaggggtttaataaagttggataactttgtaaatcttttaatcttttatgaaatagaataagatgatcattttcttcaatagctgttctatataaatatttttttaattttttattttttaaaaaaaaagcttgtccacgatataaagcttgtgcacatatttctccacaatgattaacacgcattaatccagaaatatgttttaattgttttttattgaattttcttattttcttattttgattttcattaatttcttctttaagatttatattagaattagtatttatacttgtaatagcctgtcctatttctattaaaattttatctataaagttaaacatcttccttatttttatccaaaaatgttttaagagcctcagacctacttggatgccttaattttctaagtgctttagcttcaatttgtcttattctttctcttgtaacatcaaattgttttccaacttcttcaagagtatgatcagtattcatatcaatcccaaaacgcattcttaaaacttttgattcacgaagagttaaacctgataaaatttttcgagttgtttctcttaaattttgataagttgtaaaatcaataggagatacagaatttacatcttcaagaaaatctcctaaattagaatcttcttcatctcctataggagattccatagaaattggttctttagcaattttcataacactacgaattttttcttcaggaatatcaatgtgttttgctaattcttctggcgaaggttctttaccattgttttgcactatttttctagtaatacgattcaatttattaattgtttctatcatatgtactggtatgcgaatagttctagcttgatccgcaatagatctagtaattgcctgacgtatccaccaagttgcataagtagaaaatttatatcctctacgatactcaaatttatctactgccttcattaaaccaatattaccttcttgtattaaatctaaaaattgtaatccacgatttgtatatttttttgcaatagaaataacaagacgtaaatttgcttctaccatttctttttttgcacaacgagtttttgcttctccaatagccatttttttatttaaagatttaaggtcaaaaatagacaataaagaccttttttctgtatatcgaatttttctttgtatattaataatatcatctttatatacagaaatcgtttcttttaattttggatatttaaatattaaattttctaaccaatataagttagttgcattttttgaaaaacttttaataaaaatttttttattcataccaccgtattttacacaatatttcataatcatatgttcgtattttcgaatatctgataatgattttcttaaagattttgtaatggcattaaattgtgaagtagttaattttgcttttaaaaagcattcggacaaatctgatttagcttttttatatttttcaaaatttatgttcttttttttttgtgtaaataaaaaattttcatgcaaaatttttaatttttcaaaaaaattgattaactcatctaatttagttttagatggcaatgtattatcttttttttctttagaagaaaaaaaacaattatttatttctttttttttattttgaatatttaataaagatccaaaatcgcctgataccatttcaatatcatcagatgaattcaatgaactaacaatattatataaatcttctttctcttcttttaaaatgatggattcatatatattaataatatgaccaataatagcgggataagaaataattgcttgtaaaacttgtactgttccttcttcaatacgtttagcaatttttatttctccttcacgagttaataactctaccttgcccatttctctcatgtacatccttacaggatctgttgttcggcctaattctccatctattgtaactaatgcagcygcttcttctgcaagatattcatcatcattattytctgaaacaaaaaaatcatctgtattaggaggattttctaatacatttatgttaacgtcatttaaaagatttataattgtttcaatatgttcaggatctgatatttcattaggaatatgatcatttatttctgtaaatgtaagatatccttgttttttccctaaagcaattaaattatgaatatatgatattttattagtttgaataatttctgacatttttaatataaaattatttaagaaaattgattttttacaaaactggcatgttataataaattattataaaatgattgtaaataataatattcaatttatttgaaattgaaaaaaatattatttttttatttcaaatctattggcttttttttttataatttgaaaaaattgttttttttctatttctgaaagtttattagatttagattttataatcaattgttctaattttattttatttgaatatgtataaaatttagtacaaatattttctatttcatatttaatatcttttaatttttttaatggaagttctacattagatagttgagcaaaaagatctttttcttctttttttatacaaatttcatttttatctttcataaatatagagagaaaatcttcattattagatataatatttttctttaaaaaagaacataaattttgaaaaagatataaatctttttcttttttttgtatttctattttaggaatatttatatatcttcctaatttaggattttgaattaaataagcaattgcacgttgaataggatttatttttatactctttttattcacaaaatatgaaaaatcttcatatattattttatataaaatatcaatatgtattgtaatttttgttgataaagattctaaaataaaaattaaaaaactcccttttggaattaatttaattataggaattattttatttaaaattttagcttttttatctagagataaatatatattttgagaaaagaaagattttataagaaaattagaaagaggaatagcattgtttattaaaattttaaacattttttttccaaattttctaagataagaatctggatcatattctttgggaaagaataaaaataatatttcataatttccatccattgttggcaaaattatatttaatattttccaaatcgcttttctacctgattcatctccatcaaaacaaaaaataatttttttagaaagttgatacattttctgtaattgctgtaaagttaatgcagttcctaatgtagcaactacagatttaataccaaattcaaataaagtaataacatctatgtaaccttcgacaacaagaagataatgatgatttttttttttaggaatttcataaacaccataaatagaattttttttttgataaatttctgtttcaggagaatttatatattttggatatttttgaatattatttaatatacgccctccaaatccaattgtttttccataaatatttcgtataggaaatattattcttccttgaaaaatatcataaattttttctttattttttactaatatcccggcttttattaaaaaataaacatcaatttttgataattttcttatgaaagaaaaatcatttattatagaataaccaatagaaaaatattttatcgtttctaattttagacctcttttatttttaatatattcttgagcttttttagaacaataattattttctagattagaatgatataattttcttattctttctaaataaagaaataaatttttttttttcttgataaagtctttcctgaatataaaattttttatttctaggaattttcaaatgaagaatatttgctatttgaataacagcttcaaaaaaactgatatggtcgtatttcataataaaatgaatgacatttccatgtttaccacaaccaaaacaataataaaattgttttacttcacttacagtgaaggaaggagttttttcattatgaaatggacaacatgcaatataattttctcctctctttattaagagaaaacgcatattgattatgtcaataatatttactttattaacaatatattgaataaattcgcgggtaattttgttttttaacactgatacaaatttgattttttaaaaaaattaaaatagataaattaataatattttcttttgctttgtttttctctttttaattttttaatttgtctttttatagctgcagatttttctcttttccttttagcagtaggtttttcataaaattcgtgttttcgaatatctgaaataataccagctttttcacaagaacgtttaaatcttctcaaagttacatcaaatggctcagtatcttttacacgtataataggcataaatataaatttctcgcttttttaagtaatttttaataaaatgtatgaataacaaaaaattcaaatttaatatattaaatttcgaatttttaagttatactgaattatatttaaaaaaaaattaaaaaaattttctaaaaataaaattttattaatcttaaaagttatttaaaaacaaaactatataatattcattaacaaatatctataaaaatatgcaacaatatttatctttaattaaagatgttcttgtaaagggaaattataaaaatgacagaacaaaaataggaataaaaagtatatttggaaggcaaatgagatttgatctttctaaaggatatcctttagtaacaacaaaaaaatgttatataaaatctattatttttgaattattatggtttttaaatggtgatacaaatataaaatttttacaaaaaaatggagtttctatttggaataaatgggctgataaaaatggaaatttgggtcctatttatgggaaacaatggtgttcttggaacggtttaaatggaaaaacaattaatcaaatagaagatcttatatggaacataaataataatcctaatagtagaagattgatagtaagcgcttggaatgtttctgaattatcatatatggcactaatgccatgtcatataatatttcaattttatatttataataataaattatcttgtcaattatatcaaagaagttgtgatgtttttttgggtcttccatttaacatagctagttattcgcttcttactttaatgatagcacaacaatgtaatttagagattggagaattcatatggacaggaggagatatacacatatataataatcatatacagcaagcatacacacaaatttctcgaacaccatatactttgccaaaaataaaaattttaagaaagccaaaaacaatttttgaatatcaatatgaagattttcaattaataaattatcaacatcatcctcctattaaagccccaatagccgtataaaatgataaatatttctataattgcagcaattagttataattacattatcgggaaaaataatagtataccttggtatttatcaaatgatatgaaatttttcaaaaaggtaactttagggaaaaatgttttaatgggcagaaaaacttttgattcgataggaaataaagcattacctggtagaaatatgattattttatctcattataaaaaattttattctaattgtatatatattacaaatataaaaacttttatgaaaaattatcaaaatcaagatattataattgctggaggatctcaaatttatcgtatctttatgccaatagccacaacattgtatattacaaaagttgaatgttatattgatggagatgcaaagtttccaaaattttctttaaaagaatggaatgaaatttcaaaaaaaagatttatgtgcaatttaaaaaatgaatattctcatacttttcatgtatataaaagaaaaaaataaaaaagttattttatttttccttcttcatatagagtatgcgaacgtaatctaggatcaaattttttaatttttattttttgagaagtattaagtttattctttgtggtagtataaaaatgtcctgtaccagaagtagaatttaatttaattttttctcttttcccctttttagccataagtaaagattaccttaattttttattaaaaagagtaaacattttttctataccatatttatcgataattcgaatacccttttttgtaattcgcaattttatataacgcttttcgctatttatccaaaaacgatgtgtatgtaaatttggaaaaaattttctttttgttttattatttgcatgagaaacatgatttcctattataggacgtttgtttgtaatttgacaaatacgagccatattatacctaaataaaaaaatacaaaattttaaaaatttgttattataaataataaataataaaaaatatagaaaaagtaaagaaaaatattattttttttattctatatattggaaataaatatattttttagtaaaatttttgttaaaaaaataaagaatgatatgaaaccactctatactaattctcaattagagattattgaaacattttcattttttgatgattggcatcaaaaatatgagtatttaatttcattaggcaaaaaaataaaatttcctatagaagaaaaaaaagactttaatcttattaaaggatgcgaatcacaagtatggatgatatcttatcataaaaatgaaaaattattttttaatggaattagcgattcagttattgtttctggtttaattgctattcttttaaaaatttattccggacaaagggcaaaagatattcttaatatgtctctagatttcataaaaaaaatcgatcttgctacccatctaagccctaatagaaaaaacggattatttgaaatgataaattctatcaaaaaaactgcttataaaaattatattttatattatcaataatttttttaattgtattttaaattttctgtatttttaaatatttgatctgcaaattattctataaatccagaataaaattttccattaggcattttatatttttcagtaaattaataataacaatttggaattgatattctctgtatttttactttgaaccagggaatcttcagatctagtactaaattttctaagatagatagctttaaatccttttatttagatagttttagatccttttatttctccttcaaaggaatttaatttaaattcattttaggtaataaatttatttaaagtttccaaattagaaaatttatttaaataattcacagaaatagcaacatgatttatacaatatccgtatatataaaaccatgcaatatattccaaaactttcaataattcattattcttatcacaagataaagtcttacatgaagattgagtagttaataatttttttgaatcttttaataaagaagaagaaatattttttatacattctattaaaatattttgtactcatatatcaaatttttttatttctatttaactaataaaaatttttggcatatcttcattttcatgctcaaaatgttcttcgtaaatacattttttagagaaataatatttttttgaaaataaataacctgattttaaaaaaggttggacaagtataatttatatccaaaaatggatgatttatagctcgaaaagacaatatgatcatattttaatacatcatatccctctgtatttttaattaaattataaagacttttggttttgtgattattattgatatattgaattaaaaaatatttaaataaattagaaaaaaaagattttttaacataatattttcttcctttaatatgtaaaaattattctttgttccaaataaatattagaacttgtatcctagttaatagtatttttttgtcttctcatataatttttttcgagagtcagttccggattctctaccatttccagcgaatttttctcctccaaaatctcctccaatttcagaaatagatgttcttatattaaaattatcaataccaaaatcacttcttaatgaagataaaaatatttttaaaatgtgtaaattttgtgtgaaaattgcagaatataatatatgatctacttcgttgtttattatgataacttcttcaattgtatgaaatggttatatatatataaaattggtgaaaaagtttcttactttataataagcaaatcatatttcgctttaactaaagttggttcaataaaaaactttttctagaaatagaatttccttcatataaaattttccacctgtattttttatatcttgtattgcagaaatatatttattaactgcatcttgatctattaaaggacacatatgattatttgaatttatataatctcctattttgatttttttataagcatctactaaattttcaattatatatttatataaatctttatgaattaataaacgtcttgtagatgtataacattgaccttccgtactaaaagtaaataccataaaatttttttttaatcataagaacaatacttatacaaagactagaagcggtagtcatttgaattgccgaccaaatttttcccaattttttttgcaggataaaatttttctgcatagctatcttctttaagaatactgttcttataaccttgaactgatacataaactataaatacattacattatgtaatatagaagggtattctctagaatttttttttaaagtatttatatcttaatttagatttaagtcttgcattaaaaaatagattttatctatatgacctgaatatcttaaagttttacaatctatataattaatttttccaacataattatctattaaagaactagctcagccagatatatgaaatgcttcgtaattttcaccatggttttttacctgttctatttaatctaaagccggaacatatgttatctttcttttttctaatatttggcaaagatttctatattcattaattaatccatcctttgactaaattgttacatattgtaagatattactgatatttaatggtaatgtatcaataagcattttggcacgttctactttatcaaatttattaatcaaagattgtgttataatgctgataaattctggagcaagaccacgttggggtgcaaaaactgtatcaaaatttttcgctaaatatttaacttttttttatttctacatcttctgttaaatcaaacaaatttaattcaaaatttgaggtatatttatccactaaaaatgttaattgataagacaaacatgaaattactgttgtacatcttttcctatttttcctcaaccaaggattggaatattatggattatttacattgaatccctattttatagggatctattttaatagataataaaaaaaatttatatatttaaattattttttataatatgtaaatatatgtaatttcatatttatttctaatatctttttatataattttaatttttttgttttttcttttgttttttttataatagactcttttaagattttttctttttttaataaatcaatatctaaattttttaaattttctattgtattaacaataatgataacattttcgggatgtacctgtaatattccttcagaagcaaaaaaaaattcttctatattctctaattctagatatataaaacttaggcaaaatttagtaagtaaatgcaaatgtccgggaaatattcctatatcaccattatctcctcttaatgataaggatttagcttgatttttaaaaaatattccttgattaaaagaaataatttttacttccattcttttagagtttttatatatttttctatttttcattttgaaaattttttactgcttcatttatagaaccaatcatataaaaaaatttttctggtatataatcatattgaccttctaaaattccttttaaatcttgaatagttgtttgcaacggcacatattttccagattttccagtaaatatttctgctacagaaaatggttgagataaaaaacgttggatttttcttgctcttgaaacaacaaatttgtcttcttctgataattcatcaaaacctaatattgcaataatatcttttaaatctttatatttttgtaatattttttgtacttgatttttagtatcataatgatcttgtcctactatcataggatcaagcaaacgactagtcgaatctaatggatctatcgcaggatatatgccaagttctgctatatttctagataaaacaatagtggcatctaaatgcgaaaaaattgttgctggcgatggatctgttaaatcatcagctggaacatatattgcttgtatagatgtgatagatcctttatttgttgatgcaattcgttcttgtaataatcctatttcttcagctaaatttggttgatatcctacagcagaaggtatacgaccaagcaaagcagatacttcagttccagctaatgtataacgataaatattatctataaaaagcaatatatctttcccttcatttcgaaacccttctgcaatagttagccctgttaatgccacacgtaaacgatttccaggcggttcattcatttgtccataaaccaaaacaactttatttaaaacatttgatgattgtacctcttgataaaaatcatatccttcacgaattctttcccctacaccaacaaatactgaatatccattatgttcaattgcaatattattaattaattccatcatagtaactgtttttcctactccagcacctccaaaaagtccaatctttgctccttttgaaaaaggacaaattaaatcaataactttaataccagtttctaataatttaatttctaaagattgttcagtaaaagatggaggtttaaaatgaattggcatatattttgcattttttatctttcctttattatctattggttctccaagtacattaataattcgacccaaagtattatgaccaacaggaacttttataggagatcttgtattttcaacttctaatcctttttgcaatccatctattgcacccattgcaatacttcttactacaccatttccaattaattgctgtatttctaatatcaatcctgttttaagaactcgtaaggcatcataaatacaagattgtttattattttggaattgaacatcaattattggaccaataatttgaataatttttccaattacttttgtattattttgattatattctgtatccatttttttcctttatatttaaatttttatttttttttaaatagattcacttccagaaataatttctgctaattctttagtaattgtaaattgtctacatttattatattgtaattttaaattattaataatttcatcagcattttctgtagcatttttcatagacaacattcttgcagcatgttcacacataagattttcaataatactatgatatatttgggaatagatatatttagaaaatataaattccaataataatttaggatttccttcataaatataatcccagtatgatttttcttttttatatatttcttttttttgatttatttgaattggtaatattcgtttatatataggtacatgtttcattacattataaaatttattgtataatatataaatttcatctactttttctttattaaaataatcgaatatagtattaacaagattttgaatatcttcaattttaggtatattattaaaatttattttataaaataaagaatcttcataggaaaaaaaaaattcttttgctttctctcctattattagtaaataggaattgatttttttttctttaaaaatttgtatttttttttttaatagtttaaaaatttgaaaatttaaatttccacataatcctcgatctgttgatattacaacaaatccaatattcttaatattgcgtttttttaaaaaaggatgttgatactctaaatgggcagataaaatattttctattacttcagtaaaagaagtactataaggtcgaattatgtgtaataaattatggtaaattttattcattttattagctgaaattaattccattgcatgtgtaattttcctagtattctgtatacttaatatatttaattttatttctttagttgatatcattttacatccgttattttatggaatatagattttttgaaattccagaattattttctttaaatcttgtgcaatactatcacaataattgccagatatttcaattttatgaaaaattgtagaatattgatttttaaaaaaattaattagagaagttttaaaatgttgaatatcattaacttctattgaatttaaataaccattttcaatcgcaaaaaaaagaatagccatttcagaaatacttaataagttatgctgtttttgtttcattaattccatcattttttttccatatgtaatttgttttttgaccatgctatctagattagatgaaaattgtgaaaatgcttctaattctcgaaattgagccaaagataattttattgcacttcctaatttttttataatttttgtttgtgcagatcctccaactctagaaactgatgatgaagaatttatagcaggacgaaatccagaattaaataaatttgtttctaaataaatttgtccatcagtaatagaaataacattagtggaaataaatccagaaatatctcctgcttgtgtttcaataataggcaaagcggttaaagaaccactttttttttgaatttttccacaagaacgttcttttatatattcactatttacacaagcagctctttcaagtaatctggaatgcagataaaaaatatctcctggatatgcttcgcgtcctggaggtcttcttaataataaagatatttgtctatatgcccacgcttgtttagttaaatcatcataaacaataagcgcatcttctcctttatcacgaaaatattcccccatagtacaaccagaaaatggtgcaataaattgcatagctgcagattcagaagcgctggcagaaacaacaatagtatatttcattgcatcataatctttaagaacctgtactatatttgctatagatgaaagtttttgtcctatcgctacataaatacattttacatttttatttttttgattgatgattgtatcaattcctattgttgtcttgcctgtttgtctatctccaataattaattcgcgttgacctttgcctataggagttagtgtatctatagatgcataacctgtttgtaatggttgattaatagattttctaaaaattacttctggagcatttttttctataggagaaaagattttttcttgaattatatctcctccatcaatagtttttcctaacgcatttactactctacctaagaaacattcaccgactggtacagtcaatacatttcctgaaccataaacaatatctccttctaaaggaaaaattttattatctaacataattattccaataaaatcactttgtaaatttaatgctattccaaatatattttttttaggaaattgaactacctctccatacattatgttttctaaaccataaacttgtacaataccatctttaacactaattacagatcctgtattttgcaattcaggagtaaaatcaaaattttgaattcttttttttattaaatcacttatttctgaagaacttaaattcattaaatttatcccttttaagttgaaattatttaagcaaatttgtatacaaacatttaagcttatatttagtagatatatcgattattttatttccaatctggataaaaatccctcctataattttttgattaattttatttattagttttatagaaattcctaattttttattaataattttttctaaatctttaatatgtatttcttttaaggaatatgtactatatacagtacctgattgaatatgagatatatcattaatatagtatttttcaaaataataatatatgttaggaaaaatatataaatggccatttttatataagattttcataaaatttttttgatattttgttaaaaaatatgtttcagaaaagaaatctatcaattctttaaataaaaaaacagaagaataaatgtatttttgtactattttttttgtaaaaaaataagaaatattttgcatcatttctttccaagaaagaatatttttattttcaactgctagttcataaatagatttagcatatgaaattgaaatattggaagtaaaactcatatatcttttatctctttaataatatcttggataaaaatttttttagaaaaattagtattattacatagcaatttttgtaaaatatcaaaaataaccgatacaaattctttgtgcaattctcttttaacttttaatttttcttgttgtatttgattagttgctaataatttcatttctttaataatattatgtcctttttttttggaaagattaataatcttatttgcatcaatattagcattatttaaaatattgttagcttgattttttgctttttgaataattaaacaggattcatcttgcgctttttttaatttagtttctgcaagagaagcggcttttattccatttgcaattttttttcttctaatttttaatgcatttactaaaggtggccatatgtatttcatagtaaaaaatataaatactaaaaaagtgatcatttgacctattattgttaaatttatattcataaaatatactacctatcctttttatttttagaaaaataatatatatattgtaatataaatacatatattatttagatatatttaaatgagaaataactgtatttagcaatggattagaaccaaataataacataagtcccattgcaatagaaatagcagaaaatgcatctataagacctgccattaaaaacatacgtgtcattaataatccagtgagttctggttgtctagataccccttctaaaaattttcctcctaatataccaaaaccaattgcagttcctaatgccgataaaccaattaataaagcagctgcaatagcagtagcactttctatatttgcaataatttgtccagaaatttgcatttttatctccttaaaaaaaataaaattttaaattatataatatatattttctattcttgagccatatttaaataaacaatagttagcattgtaaaaataaaagattgaattgtaataactaaaatatgaaaaaccgaccaaatactaccaggtaaccattggatccaccaaggtaataatgcaattaaaaaaaatactaattcacttgctaacatatttccaaaaagtcttaaagctaaagacaaaggttttactaaattttctattaaacaaaaaataatattaattggaaaaaaatatattccaaaaggatgaattaaaaaatcctgaagaatttttcgtatatttttttctgaaaaatgaaaatatattgttaaaaaaaaaactatcaaagataaggcaaaagttaacataggatcagcagtaggaacagatttaaatgtactgactttaaaaatactcataatatttggtaaaaaatctacaggaattaaatccataaaattcattaaaaatatccaaaaaaatatagttatagctaaacatataataaaatattttctttttcggaaagaaaaagaattttcaataatattttcaactgtttcaaaagatagttctataaaattttgtaacatacctggcgtttttgaagtagcattgtataccccataataaaatattcctaaaaaacataatcctaaaaaaattgaaataattaaagtatctaaatttatagaaaaaaaattattactttgttcaaatttcattgaatgaaaattgaacatccaatgtaataaatgatgttgtatataaatatctgaattaatatgagtttttatcaaaatttaaccttatttatgaataaatttttgcaatataaaaattaaaaaaaaggaaaattgcattattaaaattcctattaaaaataatttccaatctaaattggataatttaataaataaatatcctaaaattccaataataatatattttccaaaaaaaattttacataaaaaaaaagttgtatttttggaataaatattattatttttctttattaaaaaacaaaatactgtataaatatttgctaaaaatatagtacaagacccagagaatatagaaaacactgtttttttacctaaaaatataccaaaaattactgtaaaaaaaatagaaaataaaaattgtattaatactaaatagtaagatggaaattgcacactttaaaaaaccaagaatattttttgtctaaaataaaattggcactatcctacatataaattttgtattaagcaaggagttttaaatgaaattatattaatatatttatatttttctacaaaaaaatattttcaaatatataattttaaaaaattttaaaattatattataaatatatgtctatatgttggattcaaggcaaagtaggaaaaattgaaatagctgtcaataatgtaaagaagattgatgaaaaaaacaaattaatagtatttttaatgtgttctccacatcctttatttcaaggaacaatggaaaataaagtcgttactactgtagtacgtttatgtaaaaaaatgggcatttcttctgtacgatttaattatagaggtatcggaaaaagtgagggaaaatatggaaatatatatggtgaaatagacgatacaatttctgttcttttttggattaaaaaaaattatccttcttatcaaatttggttaggaggattttcatttggtgcttcaattgcttatcgtgtttctattttatttccgatagatcaattgtttactatctcacctaatattactaattcgacttacaatagtattttggaaactaatgttccatggactgtaatacataatgatgatgatgaaattattgatacaaaaaatgtactaaaatggattataaatcataaaatttcatttcatttaattaggctcaaaggagttagtcatttttttcatggaaaattaattcaattacaaaatattttatctccaatttttaaaaaaaaattaaaaaaattatgtcatttttaaagtattatctaaatgtttgtaaaaataaaattcaaaaagattcttctcaatatcgtttagttaaaaaattagaacctgtttggtttcatttagtaaaaagaaaaaaaatatttttttataatttttttcaatcaaaaaaaaaaaataaaggaatatatatttgggggaatgtaggtgttggaaaaacatttataatggatttattttatgaatctttacctttttctacaaaaaggcgttttcattataatcgatttatacaaaaaatacataaagaattaatttctatagaaaaaaataaaaatactattgaacgggtaattcaaaaaatatgcaaaaatattcttcttttttgttttgatgaattttttttaaatgatatttctgatacattttttttagaaaaattatttaaatttctatttagaaaaaatatttattttattctaacttctaatataaaaccaaattttctttataaaggaggaattcaaaaagaaaaaatattacccattattacagaaataaataaaaatatgcatgttatacaaataaaaaataccattgattatagaacatcaaaaaattctttaaaaataaaaaaaacaaaatttcaagaaagatatatgtataaatattttttaaatttagagaaagaatttacaaaaaatattcctttaataatttccggaagaaaaataaaaaccctaagaatagggaaaataagtgtttggtttgatttttttgatatttgtatattgcctaccaatttatatgattatattgaaatatctaatcgttttactaatatatttattagcaatattcctaaaatgaaagatgatatgaatgattgtgcgcgaaggtttattactttagtagatgaaatgtataattctaaaaataatttattcatatcaacaatggtttctattaatgatatgtatgtaggaaatgatttatcatttgaatttcaacgtacaactagtcgattaattgaaatgcaagctaaaaaaatatttacattaaaataaatgatttatgaaatttcaaactttatttcttcttggagcaacagcaactggtaaaacaaaactagctattgaatgggctagtcgttatccaattgaaattattagtgtagattctactatggtctatcgaggtttaaatattggaacaggaaaacctaaagaaaagattttatcaaaaataccacatcatttaattaatttatgtgatcctacaaaaatatattctgttgctctttttataaaagatgctttcaatgctataaaaattatacgaaatagaggaagaatacctttattagttgggggaagtatgatgtattttaaatatttattaaaaggattgtctgatttaccaattgcaaattatagtattcgaaaaaaaattttagaagaaggagaaaaaaatggttggaaaattatgcataaaaaattaaaaaggatagatccagaatcttattctcgcataaactttaatgataaaaaaagaatacaaagagcattagaagtttattctatcactggatgttctatatctcaaatatggaaaaataaaaaaggtatatgttacccttattcttataaaatactaggaattcctgtagaagatagagttttattacataaaagtatttctatacgttttcataatatgttaaaagcaggttttttagaagaagcggaaaatttatatagaagatatgatttacatgaatctctaccatctatgcaatctgtaggttataaacaagcatggcaagtattttcgggaaaattgccattaaaatatttatctgaaaaaagtattattgccactcgacaattagcaaaaagacaactttcttggttaagaaaatggaaaaatatttattggataaaaaaaagaaatgatattaatttgtatatttaaattgtaataatgaatatatttttatagattgcaatttttcttatggtaaaatataacgtaatatcgatttataaaatatattttaacaatgtatataatgttttttttaatattactatgtttttttattcctgtattcgctaataatagtagtcagatttcttattctaatggatttaattggcagtcaatattattccttcttgtttttgttgcagttttttatttttttatgattagaccacaaagaaaaaaaaataaagaacatcaaaatttacttgcttcattaaaaaaaggcgatgaaattgttaccactggtggaatttttggtaaaattaaaaacttaaatgataaaataatagaattagaggttaataatggaatttttattaaaattcaaagacaatcagtaattaatttatttcctaaagggaccattttctttaattaatatttagtttaggtaatttttatatttatggtatcaaatcaaaattatttatttcctatctctatagggaaaaaaatttattatttttttattttatttattatattcatagcatgtttatatgcattgcctaatttttttagagaatatccatcattacaaatttctcctaaagaagggaaaataatgtcaataaaaaatatgcaaagaattatgtctacacttaaaaagtgtaaaatatcttataaaaaaatattatatagtcattatatactagaaatagtatttacaaatactaacttacaaatacaagctaaaaaattaataaaaaattttttaaaaaataattattctgttgctatacatatgtattctgatataccatactggttgaaaatttttcatgcacatcctataaaatatggtttagatttacgagggggagtatattttttaattgatataaatacaaatgttgttataaaaaattacttaacaagagaaatagaaaaattagaaaaaaatttatataatgaaaatatttattttaaacatatggaaattaataataataaaatcatcattgaaagcgataatataaaatccatagatcgtataaaaaaattaatttcacataaatttcctaatttgttatttaatcaaaatttctttcaagaaaaaaataaaatccagcttgtagtttctccaaatattttattaatgatatcaaaatctgctatagatcaaacaattgaagttatgaggaatcgtgtagatgaattaggcgtttcagaagcaagtgtgtcgaaagaaggaaacacaaaaatagcaatagaaatacctggtttacaagatgcagttcaagcaaaagaagtaataggagggacatctagtattaagtttatgttagttgataacaatgctatattatcagaatctccaaaaagatctatttactattttttatctcctataggagaaaaaagtttttttgtattaaaaaatcagattgtactaaatggaaagtccattattgatgcgcaagtaaattattcagaagacaataacttaccagttgttaatattagaatttctggcgaagaagtttctaaattcagtgatatcacagaaaaaaatattgggaaacaaatggcaattgttttaattcataataactttaataagtctaaatttgatactgatgaacgtataataagcattgctactattcaacaaaaacttggagatagttttcaaatatcaggacttaataatattcgtgaagctagaattttagcattaaatattcgttcaggatcattacctgccccaataaagattgtacaatctaagcaaatcggaccttcgctaggaattgaaaatattcgtatgggtaaaatttctatttacatttctatgttattaattaccatttttatggtaatttattatcatgcttttggtattatagcaaatatttctttattattaaatttaatatttattatagctataatgtcaattatacctaatacaactcttacattatcaggtcttgcaggaattgttcttaatataggcatgaatatagattctaatgttcttatattcgaacgtattagagaggaaattaataaaggcaatttcttgcaaaaagctattcatataggatatcaacgaactaatataacaattatagattcaaaccttaccacattaattgtttcttttattctatttacaattggaactgggtcaataaaaggtttttctattactattatgataggtattttatcatcaatgtttactgttttaatagttactcgtattttaattaattattttgtttcaaaaaaaatgatattacgatatttatcaattggcatataagtttataaaacaaaatggaattttttaaaaaaactaatattaattttttaggatttcaaagaattgcaatatttttttctattattttaagcattttttctgtattttttattatttataaaggtataaattgggggttagattttactggtggttatgctatagaaattcatttaaattcggatttttctaatgatcaaatacaaagattaaaaaataaattttctacaatttctggtattgaacatataaaaatagttacttttggcggtgaaaaagatcttagaatttccatacaaactacagatatggatacaaaatcaaataaaaaaatacctttaaaaataataaaatcaattaaaaaagtctttaaaaaatatggaaaaattctttctgttaattatataggaccagaaataggaaaagatttaatgaaaaaaggattcttagctatcttgatctctttatttgctatgatgttttatattagcataagatttacaatccaattttctattggttctataatagctttagctcatgatcctttaataatctttggatttttttctttttttcaaataccttttgatttaaatacattagcagctattcttgctgttattggatattcgttaaatgatactgtagtaatttatgatagaataagagaaaaatttaaaaatttctattccagaacaacaaaatcaattgtattaaaaatagttaatcaagctataaatgaaactttatcacgtacaattattacatctggattaactttatcagttttattggttttatattttttaggaggagaaacattatatggattttctttagcacttattataggagtcattataggaacatattcttctatttatatagctagtgcgctagcaataactataagcttaaaaaaaataataagaaataaagaaaaaattttataaaattaataattataaaataaaatttattttttacatatatttcattatatgtattattaatataaaaatactattcattattatgataaatattaaaaaattagataaagatccaaataagattataaaaaatcttaaaaaaagaaatttttcaatagatttttcacaacttatttccttaagaaataaattgcaaaaatcaaaaaatgaaaatcaatatttacaaagaaaacataatgaaatttctaaaaaaaattctttttcttgcaaaaaagaagataatcaatctctatttaaagaggcttatcttttatctcaaaaaataaaaaaaaataacaaaaatattagttttttacaaattcaattaaataaatatatatcaacaattcctaatttattggattctgatgttcctgaagggaaaaatgaatctgataatattattatctactgttggggaaatccaaaaaaatttgattttattccaatgaatcatattcaattatctcattctattaaaggaatagatttaaaaacttctagcaaattatctggttctcgatttagtataatgaaaggtgaaatagcagaattatacagagctataattcagtttatgatggatgttcatatttatgataatggatatgttgaggtatatataccttatcttgtaaaaaaacattgtttgtttggaacaggacaactaccaaagtttcataaagattatttttatattcaaggcgattctaatcttgtattaattccaacttcagaagtttcattaattaatattgcatctaatacaatttattctgataaagatcttcctataaaaatggtagctttttctccttgttttaggaaagaagcagggtcctatggtaaaagtacatatggaataatgcgtcaacatcagtttgataaagttgagttagtacagcttgtaaaatcagaaaattctgattttgcacttcattctcttactaaaaatgcagaaaaaattttacaaaaattagaattgccttatcgtttaacaaaattatgttcaggaaacactggattcagtgcaagcaaaacttatgatttagaagtttggattccaagtcaaaataaatataaagaaatttcgtcttgttctaactgtagagattttcaatctcgtcgtattaaagcaagatggaaaaacaaaaaaacaggaaaaattgagttattacatacattaaatggttctggattagctgtgggtcgtacattgatagctattatggaaaattatcaaaatattgatggtaatatcttaatacctaaagtattgcaatcttatatgaaaggtaaaactattattcaattatcaaattcaaggagttaaaaatgggatttttaaaaggaaaaaaaattttagttactggaattatgagtaaccgttcaattgcttttggtatagcaaaagctatacatagagaaggtggtaaaatggtttttacttatgtaaataaaaaatttaaagatcgaatatctaaattagtaaaaatttttaatcctgtctctatattaccttgtgatgtaagttctgataatcaaattaataatttatttgatatgttaaaagaatattgggaaaactttgatggaattatccattccatagcatttgctcctatggatcaattagaaggtgattttctttcaaatataacaagagaaggttttcttactgcacatgaaattagttcttatagtttatgtgcaatagcaaaatcagcaaaaaatatgatgaaaaaaagcccctcttctattgtagcattaacttatttaggttctcaaaaaactgttgttaactataatactatggggctagcgaaagcatctcttgaatcttctatacgttatatttctcaaagtttaggtcctgataatattcgtataaatgcaatatcatctggacctataagaactttggcggcttcagggatttcaggttttagaaaaatattagattataatgctaaaatatctccattaagacgaaatgtaacaattgaagaaataggaaatattgcggcatttttatcttctgatttatcatcagcaattacaggtgaaataatttatgcagattgtggatttaatacaattggggttgcaaatttataagcattttatatatgaaaatataattatgatatatatttctacttgccatgatccatttatcaatcttgcaattgaagattggttattaaaccaaaaaaaaagtaatcaaacattatttttatggcagaattttccatgtattgttattggaagagcgcaaaatccatggatagaatgcaatttaaaagaaatgcaaagaaataatattccattagttagaagacaaagtggtggaggagctgtatatcatgatcttggaaatcttaatattactattttttctgccataaaagaacattccattataaaaaatttagattttatttctaaaataataaatacattaggaattaaattaatttctaatgaacgaaatgatttaatagtacattataatagcaataactataaagtttctggttctgcctttagacatgttaaagactatgcatttcaacatttaacacttttagttaattgtaatttaaaaaatttaaaaaaatatttaaaaccttttaataaaggaattatttctaaaggaataaagtctataataagtccagtaattaatcttaatcaaattgaacctaatttaaatatttcaaaaattcaagatgctttaatatcttttgcaaaattagattctaaaaaaaaaattattaaaatatctgcaaaaaaatataaaataaacaaaaaaaaatttgtaacttgggaatggtgttttggtaaaacacctccatttgtacagaaaataaaaaattttgatgcaaaaaaaatagttatttatgtagaaaaaggaataatcactgatattaaaagtaatgaaatatctgaaaaacatttaaataaaataaaatataaatttttatgcaaaagatattgtataaaaaacattaaaaatattaaaaattattgaattattgtttataagaaaaattaattgtgaatataatgtttatatattaattaggatgtattatattctaatatgttgaaaaaattatttttttttaaaaaaattaatattaaataaaataattatattatcatattaatattttatatataaatcattttttaaaattaaagattaattttttatatttatatattctaaatacagatttttcataaaaaaatataattattatattcgctaatataaaaaaataataaaaattttaattatttttttaaatttatagagatacacaaaatattctgtatctctataaaaataaatttaaaaaattgtaataaattaataatttttatcttagtaaagaaaataaatttttaatatttttttctaatttaggtataatagaaatagtatttccaatattatattcttttgataattcataaaaacataataaaacactaaaatcttccattccaattccaacagagtcaaaaattgtaatatcatcattagatgatcttgcaattttatttccagtaataatttcccatagttctgcatatggatcagtatttggagaattttgaatttctccctcaatacgtgattgtttggtatattctacaataactttcgatctttccaagatttttgggtctaattctacttttccaggacaatctccacctacggcattaatatgtacaccaggttgtatcatagaattagttagtattttattgcatgatttatcagctgtaagtgttgtaataatttcactttcattcaccacttcttcaatgctggaacaagctattaatttaataggatatttttttaaattttctgaaaatttatgcatagcaaaaggatctatatcaaaataacggatagtttctattcctaataaaaaatgatgcgataatgcttgaaattcagattgtgctccagttccaattatgcccataatttttacattaggttttgttagataatgcgaagccaaagctgatgtcgctgctgttcttaatgctgttaataaactcatttcagaaatcattaaaggataaccatcagatattttagaaagtgcaccgaaagcgaagacacattgtttgtttttttttgtatttattggatgtccattaacatatttaaaactgtaatatttttcattagaaaatggcattaattcaataactccatcagaaaaatgtgtagcatgtcttggagaaagttggtatttttcccaattactaaaatcatatttaagttgaaaatttaatcttttaaaacattgagaaatgccaattttctttactagagatacaacattttcaacagttaataatacaacatctgacattgatattctccttaatcataaaatttaaaatgataagtttttaaatatttttttataaaattgtggtggaggcggcgggatttgaacccgcgtccaaaaaaaatcagtttttcagatctacatgtgtagatagtttatatgttaaaacaattgtatttgcaaaactatcaataaataacaattgagtttttcatataattatttaaccatatttttttaatgaaaaataaaataatacggcgatcttgcttataatatgaacatccttataacttgcaagccatatgttataattttgttgatgttgttaacatgttaacaaagttttacttaagcaactttttcttctgtaaaacattcatcattttgagctacttcttctcttacaaattgtatctcataatcattttcttttccgtttatttaaaatataatagttattcataattacgagagaaactattatcactcgacatgcacttcaaacctcatatattttgtcgaatcctaaacgcccccttaatccttcatatattatgttaaatattaaagtaaaatttctagataattaaatttaaaatttaataaatttttattatcaaatataacgtagtataccattaaatttaaaagattatatattttttttaaaaatttttgcatattctaaatattttttatgtaaaattaatgtatcagattttaattgatttttacttgttatatttagcaatatatcattagatatttctaatttttcttttatagaaggttgagaatttataatctttttaaatatttttttattattattctgattcataagaaaccttcttatttgtttttcaaaagtacttaatacacataaaactctattaataggatattctaataatttttttttattaagtaatggaatagcaataatacaatatattgatttattattattaattcttttattagttatttttcgaacaaaaggatgcaataaattttctatccatattcttttttgaaaattatgaaaaattatatttcgtagttgaatacgattaatttcttgattatcttctaatatagatgttccaaaattttgaataatttttctccaaaaaaaggttttttttttaattaatttttttacaatttgatcagtatcaattattgaaatatttttttcagaaaaaaaattagcaacagtgctttttccagaagatataaatccagttaatccaatacaatataccataattatgttataataaaataattaattaattcattttatattaatttattttatattaaaataatcgtatatatatatcataaatagattatatattatgaaatctattttaaaaaaaaataaattttatgatttatatcataattacaaagatactttatatggatgttcaaaaattttttcaattatataaaaacaatacaaaaattgttatgactacttgttatgattttttatttgcaaaaattatttcaaaaacaaatattgatgctgtattagttggggatagtgtagcgatggtttaccatggatatccatcaactatttatgctactatggatatgatgattatgcataccaaagcagtagcaaatggtataaaaaaaaaaataattatagcagatttaccttttcttagttatagaaaaaatttaattttaacaatgaatgccgtagaatctttaattaaagcaggagcaaatgctataaaattagaaggaatcaatggaaatgagaaaataattcgatatattgtaaattcaggaattcctgtaatgggacatttaggcttaactcctcaatttatcaatcaatttggtggatataaaatacaaggaagagataaaaaagcatcttataaattaataacagaatctaaaattgctgaagatatagggtgtttttctattgtactagaatgtataccatcaaaattagcaaatattattacaaaaaaaatatcaattcccactattggaataggcgcagggaaaaatacttcaggtcaaatattagttttatccgatatattaggaatgacaccagaatttaatacaaaatttattaaatcttacttaaatggatatgataagatacagaaagtaattgaaaattatgttttagaagtaaaaaagatggtttttccctctaaagagaattcttattaattataattaactattgatttattatgatagtaatacgcgatcttttaaaatggaaaatttacagaaaattgatatcatctaaaaaaaaaattggtgttgttatgacaatgggatgtttgcatattgcacatgaatatatgataaataaatcaattcaagaaaatgatattactattgttactatatttattaatccaacacaatttaattgtaattatgatttgcaaggatatccgataaaaataaaaaaagatttaaaaatttctaaatcattaggagtggcatatgttttattgccaagatatagtgaaatgtatcctgaacgttattcatatagaattactgaggataaattcagtaaaaaattagaaggaaaatatcgattatattttttttctggggtattgacaattgttatgaaatttttaaatttaatcaaaccaaataatgcttattttggcgaaaaagattttcaacaatttattttgataaaagaaatggtaaaagcattttttcttgaagtcaatattattttttgtcctactattcgagaaaatacaggtttagcagcaagttccagaaatgttctgttaagcaaaaaaggtttagatttagcaaagaaattatattttattttaaaaaaatataattcctctcaagaatgttattttcaattaaaaaaattaggattacacgtagaatatgtaaaagattataataaaagacgttatgcagccatatatatagaaggtgttcgtttaatagacaatataaaaatataaaacaattttattttttatgtaagttaaaaatattttattaaaaatataaaaaattatgaaaattaattggtttcctgggcatatgaataaatcccaaaaaaatataaaaaaattatttaaaaatatagatatttgtttagaaattttagatgcaagaattatttctgcaagccaaaatccaatttttaattcatggaaaataaaaaataaaacaattaaaattataaacaaaattgatttagcagatcctataatcacaaaaaaatggatttttaaatttaaaaaagaaaagatgtctgtattatctataaataaaaattttaaaaatattagtaaatatatcttgcataagattaataatattttgataaaaaaaggaaatatagtaaatccaattaaaattatagttatagggattcctaatgttggaaaatctagtattattaatcaacttgtaaaaaaaaaaatatgtcaagtagcaaacattgcttctgtcacaagaaacattaaagaagtaaaatttaaaaaaggaaaaattttaatttatgacacaccaggtgttatgtggacaggaaaatcctgtaaagaagaatatggataccatttagcattatgtactgcaataaaaaacattgcatttaaatatattgatattacaatatttttaattaatcatcttaaaagatattattctaattgccttaaaaaaaaatatggtattcaaaattttttaaaagattcagaagatattatcaaggaaattggaaaaaatcaaaatttgatatcttgtaataaaaatgtttctaatatttttattttagataaaatttcacgaagaatcattcaagattttcaatcttctaaattaggccgtatatctcttgatataatttaaaaaatataatatggaaacataaaattatgatctttaaaaaaaaaattactgttttttcattaattatgcttaacgttattgcagtagatagtttaagaagcattccgtttgcagcaaaatatggtttttctttagtatttttttatttaattggagcgttatgtttttttattcctacagctttagtatcagctgaattatctactggatggccagaacaaggaggaatttatatttggactaaaaaagcatttggaaaaaaatggggtatgatagctatttggatacaatgggtttataatattgtttggttcccagtaattttatcattaataagtacaactatagcttatattattaatccatcattaatatataataaaaattttatagcatttatggtgttgtttatattttcaggaactactatattaaatagttatggaatatatgcgtcttatcgattgactaatatttctgcaattttaggttctattttcccaataattataatcgcaataataggatctatgtggatttatgatgggaagccttctcaaattaaatttgattggaatcatttttttcctcatatttcttcaataggatctttagttctacttacaaatgttttatttagtcttgtcggaatagaaatgtcatctattcatattaaagatgtagaaaatcctaaaaagtcatatcctaaagctttgttttggtcatcatttattattcttataaccttaataggaggtagtctaagtatagcagttgttttgcctaaagacaaaatagaattgttaagtggtatgttacagattttagatgctttttgttcctcttatcatataaaatatataaaatatataattccaatatgtattatattaggaggaattggaagtatatctgcatggatacttggacctagtaagggtattatggtatcatctaaagatggaattattccaaaatttctttctaaatgtaataaatataatgctcctgtaggagttcttagagtacaatttttaatatttttatttatttggagtatttattggtttatgccaaatgttagtagttctttttggattttatcaaatattacagcaatattatcatttattccctatatttttatatttttatctattatatttttacgttataaatttcctaatattaaacgcgcatataaaattccaggaggtatattaggagtatccataatatctttcttaggaattattacgtgtcttataacaataattattggatttattcctcctgatggaattgattatggttcattatggagatatgaattaattttatgctttggtatatttatattgcttattattccatttgtatataattttattaaaattagaatcaaggtttagtccattttccgctatttaatataccccaacaaataaaaaaagcaattataattaaagaccatataactcccaacaatttataataagaatcattcataaaatttccaattgtagcatatcgaaataactcaactatataataaataggattgaattgggatatagtatgccaaattttaggaagtcgatctaaagaataaaaaacgcctccaagataaattaatggagttaaaataaatgtagtaataattgttgaatcatcaaaagtttttgccatgattccattaatcatgcctattagggaaaataatgcagcacaagaaaacattgtaaagactgttataataggatgtataatagttgctttagagcaaattattccaatacttagaacaataatacctgtaactatacctcgtaaaattcctccaaattgatatcctaatacaataagaaatgtagacataggtgatacccataattcttcaatatgatgaagcatcttacttacaaaaatagaatgaactacattaccataagaattagtaataataggaagcataactaatcctggtaataaataactcaaatagggaattccattcatatttccgatattcgatccaattatatgtccaaaaattaaaaaatataaagttatactaatagctggaggaactaaacattgaatccatgttctaatccatctagcgctttctttttcaattaaagctaatagtgcattaatacattctcttttattcattattttctccatatttttcagataaaatatcagtaaatataagttctaattgattagatggaactgatatatcttgaattaaaatattgtattcttgcaatttatttattaaattacttatattttgattttttctaataattaccttaagagtcatatcattaattttttttatagaaaattctttaatataaagatttttcttagaaagaggttcttttaaatgtagagtaaataatttgctatttaatctatgaagtaaatttttagtactttcatgtttgataatttctcccttatgaataattgctaattctttacataaagtttgggcttcttctaaataatgtgtagttaataaaattgtcataccttgtttatttaaatttttaagcatattccacataattttacgtatttcaacatcaactccagctgtaggttcatctaaaattaataattttggattatgaattaatgctcttgcaatcattaatctccttttcattccgccagaaagatcattactaattttatttcttttatcccataaacctaccatttttagtaattcatctgttttttgatttgccattcttcttggtaatccataaaaacgaccttgatttcttatgataactcgacatttttcaaaattatttaaattagattcttgaggaactacaccaatatttttttttgcaaatgaagtttcattacgtaaattatatcccattaattttatatctccatctcctggaataattaaagaagatataataccaattaatgtagattttcctgcaccattgagccctaataaaccaaaaaaagaacctgattttatagtaagattaatattttttagtgctacaattccattacgatatgttttatttaatttgcttatttctattgcattaaaagaattcattatgtgtatttaaccttttttaatgataatttaaaatattatcaaataaaatatttaataatttaaaataaatttttttaaatattgtaatttactagaatagtaattctattccgtagaatttctataaaaatataattttataaaatattaaatattattaatttttgaaaattatttattatattttataatataatgttatatattataaattcaattgttttacattccatgattttaaattttgcagttttttacctttatatgctcctaaaaatttaaaaatatcacccatgtaatttggaagaagtagttttttaagttcacaagataaagataaagaaattttttttgattgtaaattcattaatccattttgcaataaaaaatttgtttgtgtagtaaatccgattattataaatttcatctttttcaaagatgatgcaatttctgaaaaattaacatgtgatgtaatatcttgatttcctatatattggaaaggattattatgaaatttatgcttataataacaagataaggttccatcttttctttcaggatgataataaatatttttcgaatatccataatctatccacaaaacatatccttcattaaggttaaataataattttttaaagtatttataatataaaaaatgcatttctgatctataaccatctggcaaaaaatatctattaatttttttttgccagaatttttgttttattattgatctattccatataaataaattttctttattttttttagatactccaagttcaaatatatttgactgatatatttcaaatcttttaaagggaatagaatctaaaaattcatttcctaatataattccttcaaatttataggacggaagtttatcaatccaaataatacgttttttaaaattgggaaaattagtatttaatatttttttttgttcttcccgaaaatatttattaatttctaaaatccaatattcttttggaagtctattttttttttctaataaagataaaatagctattgctaaagtaatatctttagctccaatttctaaaataattgcatctttagaaagattttccaagataggaataaaatgatatgcaatgcattttcccaaaatatgtcccataataggagcggtaatataatctttgtttcttatatttttttttgtataatatcctatttttggtgtgtacaatgctatttttaaaaaacgatcaaaagggatccaattttgatttttttttagaagataacaaatatatttatacaatgtattcataacgttttaatgtaacactaatatctttgacaatcaaaaatactttaggtttatgtattgtgatctcgatagaaattaattttttcttaaaatgtttaaagatattgtatataatattttcagctaatgtttctaataatttaaaatttccatttttacaaattttaagtatcaattttataatagattgataatttaatgttaaatttaaatcatctttgataaagatctttttttcagataatgccattttaatatcaataattatagatcgttttcttctcctttcccatttatataaacctattgaagtttttgtttttattcctaataaacttatatagtttttattatgtagattttgcatgttttttatattattaattattaattttttttatttttttttttaaataatattatattttattatgataaagtatgtaaaataattttattcttactaattttaaaaaatatttttttaatttaaaaaatttttaggagataattttgaaaaaagaacatattattcaaaaaattaaattgtgcataccagatgcaaaagtatttatattctcagaagataatattcattatactttaatagtaattagcgattcttttgtaaaagaaactagattacaacaacaacaaaaagtttattcatctttgcagaaacaaattaaatctggggaaatacatgctatatcattaaaaacatatacatataaaaaatgggctgatcaacaagataattattcaaaaattgaaaaaaaatgtatataacgttaaattaattgaatatgattcttgattttttcaagataaattattttttaatttttatatattaagataaaataaagtttagtatacaaattttataaaaaaattgattttttatatttattttagaaataaatgtaatttaataaaaaattatgataagatattatctctaatttagaataatcattgaagtaataaaaataaataatatgcaatttttagaatttgaaaagccaattattgaaattgaagaaaaaattaaagctttaaaaaaaattcaagaatatgaaagtcatataaatttatttaatgatataaaaaaattagaaaaaaaaaaaaacgataaaataaaaaaaatattttttaatttaaatgaatggcaaatgattcaaatggctagacatcctatgcgtccttatgctattgattatatagaaagaagttttactgattttcaagaattgcgtggtgatcgtgtatttcaaaatgatacagctataattgctggattagcaagaataaataaagaacctgttatggttataggccaacaaaagggtcgcactactaaggaaaaaatctatagaaattttggaatgcctcatcctgagggatatagaaaatctttacgattaatgaaactagctgaacgtttcaaattaccagtaattactcttattgatacaccaggtgcatatcctggaatacaagccgaagaaagagggcaaagtatagctatagcaaataatttaattagtatggtaaaacttaaaattccaattatcaatttaattattggagagggttgttcaggtggtgctttaggaataggtgtaggtgatcgattattgatgatgcaatatagctattttgctgctatttccccagaaggttgtgctacaattttgtggaaagatataaaaaaagcaccaaaagctgcaaaaaaaatgggtattactcctaatcgtctttttaaaaataagttagtagattttataataaaagaacctttaggaggcgcaaatagaaattatcaaaaaactgcagacaaggtaaaaaaaatattatttcaagaaattaaaacattaaataaattgactattcatcaattactaaatcaaagatatgaacgcattatgaattttggaatatcttgataaattaagataaaatgtcaaatctatctacaaaagaaatttttcaatcattaaaaaaaatttctaatatttttccaaataaaaattgggttattgcttatagtggcggtattgattcaactgtgctattgcatgctgcatgccaaatttcaaaaaaaataagagcaattcatattgatcatagatttaatgaaaattcaaaactttgggcaaaacactgtataaattttgcaagaaaattgaaaatattatgtaatagttataagttgcaaaactataaaattcttggttgtaaaaatcaagaaatttttggaagaaaagaaagatatagaatttttgcaaaaaaaattcaaagtaacgaaatacttcttatggcacatcaattaaatgatcaagcagaaacaatatttcttaatttaatgagaggaagtggtattttaggcatctctggtattcctataaaaaggaatttaggaaattctcttttatatagaccttttctaaatatagaaaaatataaaattcaagaatatgctaaaataaaaaaattatcttggatagaagatccaagcaataaaaatattcattttaatcgaaattatgtaagaaatgttattttaccacatttcctaaaaagatggccaaatacattatttgcaattaatcaatctagtaaatattgtagagattcttatttattaattcaaagccatataaattcattaataaaaaataaaaataaaaatttatcttctttatcaattacatggattcaaactttttctaagatatatcaagattctattattcgaatatggttttcttctgttactaatactgtattacctagaaaatctttaaaacacatatatttaaatattttacaagcaaaaaaagactcaaatccattattaaaaattggcaaatggaacattcgtagatataaaaaatatatttatattgtaaaatatacaaaaacatcttcaaatataaattattgtatcccttggaatgggaaaaatggaattaaaattcctggactttccattatgcttttttcaaacgatatttcacatttaattgattgtaaaaaacttaaatggtcaaatgtttctattagaaatagaataaatgttaaaaactctttaaatattaaaagtaagaaactaaaaaaaatatatcaaaaaatgtcaattcctccttgggagagggatactactccattattatttgaaaataaacaattaaaaattgcaatatctataaaaaaataaaataatatattattataatcttttatcttgcgacttttatatttataatatagattatacttctatgatcatagttaaataaatctttatataaaagaattattttttgaattatattattgtttaaacgataagggagagaaatcgtgaaattcaaattaattacacttg

SEQ ID NO: 2 - protein, 342 aa, Candidatus Endoecteinascidia frumentensis
MNYIPIPMKKIGPVKIIGKEFNIEVLVPLATFETTIYASAQRGARATYNAGGINCILIYDSMSRSICMEAKNAMSAIQIKYEIEKSYNIISMIISSTSSFASLESMQIKQIGSILYIRINIKTGNASGHNMVTKAADALIIWLLEKYSKLKYISVSGNFCTDKKVSAVNPLFGRGKSVIADIIIPDILCQKILRTNAKKIVDLNIKKNLLGSIQAGSLLTANAHYANLLLATYLATGQDAANIVEGSQGITYAKCDKKNLYFSVNIPNIIVGTVGHGKDHSFIKKNLLELGCLEKNHSYLNSRKLAIIIAATVLCGELSLLASLTNIGELMKAHQFFERRNK

SEQ ID NO: 3 - protein, 388 aa, Candidatus Endoecteinascidia frumentensis
MKIGIEDIKFYIPAFYISLKNLAKKRNVNVKKYLVGLGQEKMSVVPPDENIVSMAANAASYIVNNKNKKSIGMVLFATESGIDQSKSAGIYVHSLLDLPKNCRILELKQACYSATGGLQISYTWLLQNPQKRVLILASDIARYGLGSPGESSQGAGAVAILLSNNPNIASIESGSGIYTSNIMDFWKPNYFDEALVEGKYSCKMYLKALGESWKDYVNNTKRMYQDHDQFIYHIPFPKMANKAHKYLQEYVGLNSSNLNNVSLKLKDSLIYSKQIGNCYSASLYLGLISLLDNSVNLSNQRIGCYSYGSGCVAEYFSLRVSRKYKKYLSILLNKNLLKKRNELDIKEYEKYYLYHSRKNNSPNRIFPKITQGRFRFFGIKDHKHIYGE

SEQ ID NO: 4 - protein, 339 aa, Candidatus Endoecteinascidia frumentensis
MKKKKNNICRMSVPGKIILTGEHAVLYGGPALIVTINLFCNVLICSEPEKIKLEFLDINYFNTCTFYELQKIQIKLKNLQSDFFKKKTNISLQDFEIIQYSIYRILKKLKFNFTSGLKIMIKSDIPIGCGMGSSAASIIGVNYAIMKYFQNYIDDISQFLLALEIENIQHGKSSGIDLYTIINGGCYWFSNYINKKYKLIIDKLLIINTGKPISITRDCVLSCKKFFLSDKNLIKKFSVIAKTIKNSLLSYDKSSLICSVKYNHRLLVSIGVVPHKIQNLINHIEEAGGAAKICGAGSISGEKGGIIWIVGEKKILTPVVRNQGYKIKEIHITYEGVYY

SEQ ID NO: 5 - protein, 322 aa, Candidatus Endoecteinascidia frumentensis
MIFHASAPGSLMIMGEHAVLHNHPCLITSISSRIHVKLKPRNDKIVSITSILGKWKGILKNFPQKCQYQFIVKTIEYFNPNNGFDLFITNEFQSNIGLGSSTAVVVSMFFVFNEWMKTNFHKQKILLCCIKVIQSIQKGIGSGADVAASIYGGLIIYRKIDSFLKSTIIIRSLSFKLPYSIFVIYSGRKISTFDVVQYIEKKICPKKKFFLYRKIGKLVKKMEIYLSKKDNNKIFNNIITSHRKIQKQLNLHTPQINWIFKKLKDNKKIYCFKISGAGLGDCIIGFGKCSKKLFKYKYALKNCIFLIPIQIGQMSDGAKIHI

SEQ ID NO: 6 - protein, 332 aa, Candidatus Endoecteinascidia frumentensis
MEQKYIYKHPIYSILKDPGYPIMETATAFAPTNIALIKYWGKRNSFYNLPFTSSISISLRNKGTLTTISLSNDGKDKYYLDKKFMHKEHPFSQRIFKFLNGIRPKKLGFIIHTQNNFPSNVGLASSASGFCALVLALNKLFNWKMSYIDLSRLSRIGSGSACRSLWNGFVKWQSGKDFQGKDSYGIQLNISWKEFRIGIPFINKKKKIISSRIGMNHTVKTSKDFFLWIKYTKKYLRIFEKSLYEKNFQNIGYITESHSLYMHTIIENSIPPIYYRTIETLKIQKKVYNLRKNGISVFFTQDAGPNIILIFLNDIEKIIQKKFPGINIINPF

SEQ ID NO: 7 - protein, 125 aa, Candidatus Endoecteinascidia frumentensis
MKNINHSIEFITLCKSAKKKIKEISTDEVYKKNKNNHTLYLFDVRDYYEYNSGHICNAQFLSKGWIEAKIHNFVSNKFSFIILYCGSGNRSALAAENLQKMGYINVFSMKGGIKSWIQEGKPIII

SEQ ID NO: 8 - protein, 170 aa, Candidatus Endoecteinascidia frumentensis
MNIIEIIKNFNWIDEIFILIICFSSFVGFYRGFLKEIISFIKWTLIIIGTIYLGYQFSIHVSHTIYNTKLSIYICYIISFFIVFIVASILIYCFKILFISSEESIINKILGIIIGIIRGMILIIILTYFIQLFGISKSEIWKSTYFNQYIEEGLKIINIYFKKYFFDFIK

SEQ ID NO: 9 - protein, 422 aa, Candidatus Endoecteinascidia frumentensis
MSPKKFLNLTNGFIKKNINITHNDFLSFKKIVKKLKLNISNIPIITIAGTNGKGTTINLIYRFLLYYQYKVGMFISPCIFKINEQIVVDSYHPSDIDLINIIEYIKTDLKKINSNVTYFEFIFLITLKFFKLKKPNIILLEVGLGGLFDATNILNPIISVITTIDFDHQEILGNTRNKIGLMKAGIFRTNSIGICGDPKPPKSVILYAKKLNMPLLIQNKDFNFKENFFYWYWNSKKNFFNKLPIPNIPLQNASTALMVLEILQEFYNINILSHNVLIKILKNFNVIGRMQILNFYDKKIILDVAHNIQSTKYLKYFIQKKFYDKKIICLFSSLKDKKYKEMIRILDSLQAEWHFTFLQNEKRAASIKDMQSALFKKSFQHKSVISACQYLIYSLKSNDLLIIFGSFRVIKESLLFFKKIHI

SEQ ID NO: 10 - protein, 294 aa, Candidatus Endoecteinascidia frumentensis
MSWFKNILPSRIRTEILKKKKGVKEGIWEKCPSCSETLYIPELEKNLYVCTTCEYHFRISARDRISFFLDKDGQKEINKNNFPNIEDLDKLKFKDTILYKDRLLSAQKKTNEKDALIVIKGKINGLSIVMAVFEFEFLGGSMGTLVGKYFVQAIDIAIKKKIPLICFTASGGVRMQESVFALMQMVKVSAAIKILKQYSIPYIVVLTDPTTGGVSASLGMLGDIHIAEPQALIGFAGQRVIEQTVREKLPKDFQKSEFLQDKGMIDMIVPRYKLRDEITSLIRKLQKIPINYVS

SEQ ID NO: 11 - protein, 265 aa, Candidatus Endoecteinascidia frumentensis
MNNIVLGISYKGTNYYGWQGKNKKYFIQYHIELSLNKVANHKINTFCAGRTDRGVHAIGQVINFFSFANRSLKSWILGTNRYLPKDIRVIWARYAERNYNARFAAISRQYRYLIDQNKVMLPIFFGKITHYPYELDRKLMNDSSKCLIGEKDFSSFRSSQCQSKTSIRKINYINIWQKKKIIGIDISANSFLHHMVRNIVGTLLIIGQKKKPIEWMKIVLKKKNRKYAGITAPPAGLYLISVNYPDKYNFPKLSNFTMEDFYELV

SEQ ID NO: 12 - protein, 189 aa, Candidatus Endoecteinascidia frumentensis
LKKIIIGITGASGIIYSQRLLEILFSNPTIETHLIVSKSSEQIRHTEIDKTSLELKKLANYHYNVNNISALIASGSFRTNGMIIIPCSMNTLGEIANGISRNLITRAADVVLKEKRKLILVTRETPLHIKHLENMVQATKIGAIISPPIPAFYNKPESIKDLIDYTIVRILDLFNIKVNFLVKRWGSIY

SEQ ID NO: 13 - protein, 237 aa, Candidatus Endoecteinascidia frumentensis
MVILWKAKFKKFHNFQKLLEKFLSKEEIVRAFRYKFNYLRSNYIIARGILKILLAFYTNCDISNINIKNGKNGKPYIDHISNIKFNISHSSEWFVIGIGYNYELGVDIEKETYKNYLSLAHFFFTKEEYFHLLDLPFKKQRKLFFQIWVQKEAFVKAEGVGLQFGLNQFLVSCNNKPGLLKIYKKKFPYSQWKLYFFSPEKFYFGAIAVNKKISKLSYYSIIENIINKLIPIVLPKN

SEQ ID NO: 14 - protein, 76 aa, Candidatus Endoecteinascidia frumentensis
MNISKILWSSRRGMLELDILLQYYIKNFYFISSEKRKKDFQKMLSYHDQYLWNWIIQGKVPKNKNFQKIIDHIRKY

SEQ ID NO: 15 - protein, 276 aa, Candidatus Endoecteinascidia frumentensis
MNKIIWYNLLEYGYIEIYGKEYNSFLQSQLTCDIRKIKKNECIISSHCNRKGRIISLFWIHKIDNSVRLIMPNDVIDIALEHLKKYSFFSKIYFRIKKFSYLGIKIKKNYVFPSSFFKKKIVKIFENKYLYCISKNEKINFEELSSINIWEQYFIKKYHFFLFPETIGKLLPNNTNLEKLKGLSFNKGCFIGQEIIARTHFLGKNTKKLILLHSSGKPKILENIKNEKNQDCGKIIFFSKKLNKKQFCLAIIKNVSYQENKILTTEISKHTVIIKK

SEQ ID NO: 16 - protein, 169 aa, Candidatus Endoecteinascidia frumentensis
MNKKVIEKKENFLLQEEKNKEIKKENGKNKKNTKRIYQNNKREKKNKSIIEHSIIEEEYYKNLTTERLEKMNNNELLQQISNLKSLLYKEKIRREVAKKMTNDAKYYSDIIKEQVSKRINEIQRITQETIFSLEKEIKKIKEISEKDLKFYRNQLQKANEKIKSFQKKN

SEQ ID NO: 17 - protein, 251 aa, Candidatus Endoecteinascidia frumentensis
MLILSNVSTKHLGKLFLISTKFEVNKITAILGPNGAGKSTLLQSSSGMPISNGLITLNNNNIENWSYQKKARHFAFLSQNLSMSSNLVVKDIILMGGYAWKKNQRNLSLIKIISNMLNIEKLLNNYYNQLSGGEKQLIHFARLLFQLQLGYTKRTQFLFLDEPTTYLDMNVQILIFRMLKNILSDSLGIILVLHDLNIALHYTNHVKLMKFGKIIKEGDPKNILNVKNIYDIWNVQVKIIQYNGKSFIIQY

SEQ ID NO: 18 - protein, 348 aa, Candidatus Endoecteinascidia frumentensis
LIILLHIILNKEMLTKYKYIKSKCIVLLPIFLALYNIKVGKIVISWYDIIHILFFHKFNNHLLYQIIWKLRIPHTLAILISGFSLSISGSVMQGLFRNPLSDPSLLGVSSGSQFFIVICWILGAGSLWEFSLWMPLSSLIGGMLSILLLFYLSKYISLFNISKLLLLGIILNMGISACSSIFILQLTNMQLQELFIWNMGGIIQKNWHLLGISGLMTVISFIILTSQSSKLDLLILGEIDAIYSGVDIYKLKRNAMIGIALSMSASVSLIGPIVFIGLIVPHIMRIISGSLHKKLIWHSGLAGSSLLLLTDNISRSFFKNFYLPLGIIISLYGVPIFLFIMFRYNKEI

SEQ ID NO: 19 - protein, 226 aa, Candidatus Endoecteinascidia frumentensis
MKKKFQIKGGLFTLSVLQLHSIDFILLNEVLEAKKNINPNYFKLAIPIVIDVKNLNIENIYNLNFKKLKEVLFLYKIYPVGFKGISERYIQKYIQNHGYPILNSNQYFSLEKKKYYQKNSLIITDPVRSGQQIYAKNRDLIITNNVSPGSELFSDGHIHVYGTLKGRALAGINGNTSARIFCNKLEAELVSISGHYKIFENSHNFRTIKLIQFYLKNGKLIMSSLK

SEQ ID NO: 20 - protein, 454 aa, Candidatus Endoecteinascidia frumentensis
MLQIYNTFTKKKEIFYPLQEKRIFFYVCGVTVYDYCHIGHARTYLIFDMIIRFLKWRGYKIYYIRNITDIDDKIIYHAKKNKENIFNLTSRFIKIMNKEFLDLGMLKPNQEPRVTENIDHIINMINILLKNRNAYISKNNNIYFRVSSFPGYGKLSGQNINELKIDNEINQDQEKENPLDFAVWKSVSEDQCIGWMSPWGYGRPGWHIECSVMVNRYLEKKCDIHGGGKDLCFPHHENEIAQFESVYTSKIANYWMHTGMVRYKNQKMSKSLGNICTIHNIRSKYPSEVIRYFFFLSHYRKNISYDEKKLLSAKFSLIKLYSALQNMYFPKKIHFQSSYTKQFIDSMNDDFNTPKAIFILFKCAKKIKSLKKTNFSLASKYAYELKYLGSILGILQENPKKYLKSTKNILDENIQSLIKKREIARKNKDWKNADKIRNILSDYGIHIKDKSILE

SEQ ID NO: 21 - protein, 70 aa, Candidatus Endoecteinascidia frumentensis
LEFIGNNKLKKLLNILVCPLCKEKLFFQKNIQELWCKKDYISFPIREEIPILLQEESRNLTKKEIDFLNS

SEQ ID NO: 22 - protein, 290 aa, Candidatus Endoecteinascidia frumentensis
MLVKEVLFDVFYRLKKSSSYYGHGTNNAWDEANWLVSAIVKRENLNIKKILNKKIQKNLLRKIRTILDNRLTYKIPLSYLLYESYFAGIKFYINKNVIIPRSPFAEIIKNKLLPWIKIENAKFILDIFTGSGCIAIALAYYYPHLKIFASDISFSALKIAKKNARHYSLEKKINFIQSDIFKNIYQNNFDIIFANPPYIDEKKLHKLPKEYSYEPIISLKAKMGGLFYIKEILMKSKKYLSENGILLVEVGDHQKKIMKMYPNIPFIWLTLYCGGQGIFMLYKNDLKNLF

SEQ ID NO: 23 - protein, 417 aa, Candidatus Endoecteinascidia frumentensis
VCNKLFQNIKKFINHATNYSKIDSEVLYRLEHMDSVLKFSIPVRMDNGKLNIYQGIRVQHNNSRGPTKGGIRYHLNVSLDEVMSLAFWMTLKCSVANIPFGGAKGGICVNSKSLSKTELEKLSRGYIRKIAKFIGPNTDIPAPDMYTNEKIMGWMMDEYNVIHQKKIPSVITGKPIYIGGTLGRTEATGRGAYICLKELEFIHKWSPNKIKIAIQGFGNAAQNIAQLLHIDGYKIIAISDSSTAIFSEDGLDIPSWIFRKNQEKSLSSIHKKDSFQYIESQKITNEKLLSLPVDFLIPSAMENQITTKNAHKIQAKYIIEVANGPITAKADEILKHKKITIIPDILANIGGVIVSYFEWIQNKTGEYWNLDSVYNKLYQYQKNAFDSVNNISIKKNIDMRTASYIYALKNLENAILA

SEQ ID NO: 24 - protein, 65 aa, Candidatus Endoecteinascidia frumentensis
MSTNNKNKPIVTKYIIKSYEKIIFCRCWKSKKFPFCDGSHRKDTIKENKNIDNMGPIIIYGEKCI

SEQ ID NO: 25 - protein, 866 aa, Candidatus Endoecteinascidia frumentensis
MPKITYLKDYQLPNYKINTIKLLFIFESINVKIINLMDIESINEKCTSLLLDGEKQELVNIAINNRILNSNEFLLTNNSLKIFQVPKRFQLKIITICQPHLNTKLVGLYKSDSIYCTQCEPNGFRKITYFIDRPDILSIFTVKIIADRIENPILLSNGNCIDYGYLNNNRHYIKWHDPYPKPSYLFALVVGKLDVKRDFFTTSSGKIVNIELYSSVENINKVDFAISVLKSSMKWDEINYGREYDLNVYMIVAISNFNMGAMENKGLNIFNTQYILADPEISTDQDYQNITSIIGHEYFHNWTGNRVTCRDWFQLTLKEGLTVFREQCFMEDQFSCNTRIEDINTIRSLQFLEDSSPIAHSIQPNSYQEINNFYTITIYNKGAEIVRMLYTLVGKLNFRKSMDTYFLLYDKKAITCDDFINVISKSNNIDLTKFKLWYSQIGTPFVYIKKKYYDKRKKIYTIILVQKYFNNLSKKPLVIPIKFALFGLNGKQIKIQYKEKYNFEHILILNKKEQIFTFNQVIDFPVPSILRGFSAPIKINTKQNIKELIFLIKYDNDKFNKWNSAQIIFKKNIYFIMKNIKNKKKKIKSNTYFFQEMKNIFNSNLDPSFIAEMFTLPKKNIFFEENNSIDIDILEESYDFFSQNIAKYFEDFFLKKYQSIIDIDNTITPTNIGKRKLKNICLYYLCLLKSKYITDLAIQQYKKNNMTNKIFALSIIINNANSSLRKKIVSHFYLKYKYNPLLMNKWLYLQATGRYQNVFKDIQKLLKNPIYNDRNPNNINSLLKGFTKNLKEFHNPNGQGYIFISDNIIHIDKYNPQISADLVQSLIHWKNFDIRRKYLMKKELFRIYRTQNISSNLKEIIDKSNI

SEQ ID NO: 26 - protein, 167 aa, Candidatus Endoecteinascidia frumentensis
MKILLKKYNIINYFNNLKNSMAKGTVNKVILIGRLGFNPEISYTSDGKTIATLSLATNSKYKNKNTKEFVETTEWHRVILFNKSAEIAKQFLSKGKRVYIEGSIKTRTWKDQNDQKRYTVEIIASTFQILDNFSKSFENKEHNSFLNKNIETLKDSKKNFEEDDIPF

SEQ ID NO: 27 - protein, 944 aa, Candidatus Endoecteinascidia frumentensis
MKNIKIQGARTHNLKNLNITLPRNKLIVITGPSGSGKSSLALNTIYAEGQRRYVESLSIYARQFLSLLEKPDVDFIDGLSPSIAIKQKNYSSNPRSTVGTVTEIYDYLKLLFARIGIPYCPVHKIPLKNQSIKEIIQEIFLLPNKTECMILVPIVYKKEKKYKKILENFYTQGYIRARINGEIIRLDNIPKLEHSQKHKIEIVVDRFFIDKSFSKERLFESFEKAFSLTKDKFVIFLSFLWENSILKLKEKIFSNNLFCHICNFRAKQLEPREFSFNNPSGFCPSCNGLGKKYYINIKNLIPNDNLSISEGAIKFWDKKNSLHYQELKSLSKHYNFSLKKPFVNLAEKYKKIILHGSGNTEIIFSYKMQGGSFQKKGIFTGVLISLENKYKKMLSKNKELSKIIDIMTCQDCLGSRIKELSRNIYIDNMNIPKLIKLSIKNLLIFFKKIKINFFQRKISERILNDIIRRLDYLLNVGLEYLSLDRETNTLSGGEKQRIRLAGQIGSGLTGIIYIIDEPTIGLHQRDNKKLLESILHLRDIGNTVIVIEHDKEIMLQADYIIDIGPSAGINGGEILAQGNLQSILSNIKSITGQYLSGKKKIQTPKNRKKYNKKKELILFGCQENNLKNIDIYLPIGLITCITGVSGSGKSTLINDTLYPLVSKIIMGKIKKNYSKKYKKITGIDFLDKVISINQNLIGRTPRSNPSTYMGIFDIIRKLFSSVEDSRIKGYKSSRFSFNIKGGRCEMCKGDGLIKVEMQFLSDIYVTCNLCKGKRYNEETLKILYKKKNISQILNLTIKEAYYLFRNIPTISKKLKALLNVGLGYIKLGQSSTTLSGGESQRIKLAKELSKKNTGKTLYILDEPSVGLHFLDIEKLLLLLYNLRKKDNTIIIIEHNLDIIKSADWIIDMGPEGGKNGGKIISVGTPEEISKCNYSYTGKFLSNLL

SEQ ID NO: 28 - protein, 125 aa, Candidatus Endoecteinascidia frumentensis
MRHRKIGRKFNRTASHRYAMIRNMGIALFQYESIKSTLPKAKELRRFVEPLITLAKIDSVANRRKAFQKLHNKFAVNKLFEELGPRYEKRFGGYIRILKLGFRKGDCANIAYIELMDKSFSQKSQ

SEQ ID NO: 29 - protein, 342 aa, Candidatus Endoecteinascidia frumentensis
MILESDQLLKPRMVDIINIKKNTFKVILEPFERGFGHTLGNALRRILLSSISGCAVTEVKINNVMHEYSKFDGIKEDIVELLLNLKLLVIKMHKKKKEAWIEIKKESKGVVLAKDIVFPEGIIKIINPDLIICHLTTNKFLHIQMKIERGRGYVPANYQNIYNESESENLKIGNIKLDASFSPIKKVGFFVENARVGKRTDLDKLILEIETNGAISPEKAVSKAATFLHEQISVFVDLKVPKSSDIDEKKEPKIDPVLLSLVDDLELTVRSANCLKAEDIFYIGDLVQRTETELLKTPNLGKKSLNEIKNILKEKGLSLGMRLENWNSIEKRKYFFKKKGEK

SEQ ID NO: 30 - protein, 205 aa, Candidatus Endoecteinascidia frumentensis
MSKYIGPKCRLSRREKTDLYLKSGIRPLESKCNINSTPGVHGNKSRFSNYGSQLREKQKVKRLYNILEKQFLKYYKEAARRKGSTGSILLQILESRLDNLVYRMGFASTRAEARQLTVHKSILVNNKLVNIPSYILKQGDIITICKKSQKQVRIIRSLELFKKRVPITWIEIDEKKFQGVFKRLPERSDLYSDINEQLIVELYSK

SEQ ID NO: 31 - protein, 130 aa, Candidatus Endoecteinascidia frumentensis
VKSNKNSSKKKNTKRIVTDAIAHIHASFNNTIISITDYQGNSIGWTTAGGSGFRGSRKSTPFAAQVAAEKLCDSVSEYGVKTVDVLVKGPGPGRESAIRAFHIKGIKVLSIRDVTPLAHNGCRPSKKRRV

SEQ ID NO: 32 - protein, 117 aa, Candidatus Endoecteinascidia frumentensis
MVRIAGINISDTQHTDISLTSIYGIGRKRAKKICSSIGINCQKKIIELNEVQIESIRNEIKKFIIEGDLRRDISMNIKRLIDLGSYRGIRHRRRLPLRGQRTKTNAKTSKKFRKLLI

SEQ ID NO: 33 - protein, 430 aa, Candidatus Endoecteinascidia frumentensis
MLQKKNNTFLELKKKIFFVLLGLLIYRIGSYIPVPGINPEKLSHFFHIKGNSILGMFNMFSGGSLSRLTIFALGIMPYISASIIIQLMTSSIPKLEELKKEGEIGQRKITSYTRYFAAILSIFQSLAITQYVVMQKLVYYTSSTFYITSMVTLTTGTMFLMWLGEQISEYGIGNGISIIITAGILSGIPNAVIHVFEEVREGNLYLVIFFLVFISIFFVILLIIYFEKAQRCIPVHYAKRQHGRRIYTTQDSHLPLKINMSGVIPAIFASSMLLFLSTLFQWFSNIKYFFWLKNISLFLYPGTLLYTIIFAFLIVFFCFFYTALVFNPKDTADNLKKTGAFIPGIRPGEQTAKFIDLIMSKLTTIGSIYITFVCLFPIFIHTIWNIPFYFGGTSLLIVVVVIMDFISQIQSYLISNRHYSLLKNINFKKN

SEQ ID NO: 34 - protein, 152 aa, Candidatus Endoecteinascidia frumentensis
MMYLNTISLQKGKIKNKKRVGRGIGSGIGKTCGRGHKGQKSRSGGFHKVGFEGGQTPLQRRVPKFGFKSSKNLYTKKISFVNIINKLKKPPKIIDLSYLKKINIVKNNIKFVKIYSSKERTININFPIKIQGILVTKGVRKIIESTGGKISS

SEQ ID NO: 35 - protein, 65 aa, Candidatus Endoecteinascidia frumentensis
MKKIYNSKIIQVTLKRSIYGRFKKHKFCVLGLGLRKIHQKVKIKNTPENIGMINKVRYLLKVEEI

SEQ ID NO: 36 - protein, 165 aa, Candidatus Endoecteinascidia frumentensis
MNNLDIQKSDGLIEKLLTVSRNTKVVKGGRIFGFSGLTVVGDGVGRIGIGRGKAKEVSVAIRKAMENARKNMIRVQLNGNTLWYPIISEYCSSKIYMKPASEGTGIIAGASMRAVFEVLGIKNVLAKAYGSTNPINIVKATINGLKNSMYPEYVYKKRKRHLKYN

SEQ ID NO: 37 - protein, 119 aa, Candidatus Endoecteinascidia frumentensis
MKIKKIDSRIRRKKKIKNNILKQGKLSLYVHRTSKHIYAQIIDIEKNITLVSASTIEKKISKKLKYTGNIKSANLIGEKISKRAIKKNIFSVAFNRGGFLYHGRIKALANSARKYGLNF

SEQ ID NO: 38 - protein, 177 aa, Candidatus Endoecteinascidia frumentensis
MSRIAKKNIIIPKNVEIKISESFIFIQGPVGSFTYKVHNLIKVLKKENKISISVKIDSKKSWSQAGTARSIIYNQLLGVQRKFEKKLLIIGVGYRAKLENNILYLMLGFSHSIKYAVHEMIDIKIINQTEIIIQSSDKRLLGQTAAEIRSYKPPEPYKGKGIRYENEYIFRKSSKKK

SEQ ID NO: 39 - protein, 130 aa, Candidatus Endoecteinascidia frumentensis
MSMQDPISDMLTQIRNSQNSKKKFVKLYSSKQKKEICQVLKNEGFIKNFYIYGKIKLKLSIELKYYKNKPVVDMIKRISKPGLRIYKSYKKIPKVFGGLGIAIISTSKGMMTDHSARNLKLGGEVICYIA

SEQ ID NO: 40 - protein, 121 aa, Candidatus Endoecteinascidia frumentensis
MFFLVKCFKFSSHKKIKGLNMAKKCMIAREKKRMKLISRYAIKRKKLKDIIKNPNIKAEDKWKANLKLQQLPRDSSISRLTQRCKITGRSRGVYRKFGLSRTELRRRVMEGDVPGVKKASW

SEQ ID NO: 41 - protein, 180 aa, Candidatus Endoecteinascidia frumentensis
MTRIKVFYQKKVIKYLKKKLNYKNIMQVPKILKITLNMGIGNAEKDKKKLEYAMKDLALISGQKPLITKAKKSISGFKIREGWKIGCKVTLRNNRMYEFLDRLLNIAIPRIRDFRGLSNKSFDGHGNYNFGIKEQIIFPEIDYDKIDIIRGLNISITTSANNNKECFFLLNALNFPLIKK

SEQ ID NO: 42 - protein, 105 aa, Candidatus Endoecteinascidia frumentensis
MKIKTGDEIIVISGKYKGKKGIVLKKINGNKFLVEGINIVKKHIRSNPKKGIDGGIHKKESPIESSNIAIYNPISKLPDRVGFQFLKNGKKIRCFKSNKKEIIIK

SEQ ID NO: 43 - protein, 122 aa, Candidatus Endoecteinascidia frumentensis
MIQMQTELKVADNSGARRVECIKVLGGSKRRYANIGDIIKITVKESIPRGKVKKGDVLNAVIVRTKKGIRRNDGSIIRFDSNSVVLLNKSMQPIGTRIFAPVTRELRKGKFMKIISLAEEVL

SEQ ID NO: 44 - protein, 87 aa, Candidatus Endoecteinascidia frumentensis
MKIAKNKHIVQRTLQGCIISDKMDKTVIVLIERRIRHIKYKKFMKRSNKLHVHNENNIGKLGDVVLIKESRPISKKKSWKLVKIINQ

SEQ ID NO: 45 - protein, 67 aa, Candidatus Endoecteinascidia frumentensis
MKMKDLKDKSISELKLLKGDFLQERFNLYMQRGSKQESIRFHLLKNARKNIARIETILQMRKLNENC

SEQ ID NO: 46 - protein, 138 aa, Candidatus Endoecteinascidia frumentensis
MLQPKQTKFRKQQKLRNRGLSIKGSNINFGEYALKAISRGSITSRQIESARRSISRYIRRGGKIWIRVFPDKPITKKPLEVRMGKGKGNVEYWVAPIKPGRILYELKGVHESVARKAFRLAGAKLSVLTIFEKRITLL

SEQ ID NO: 47 - protein, 217 aa, Candidatus Endoecteinascidia frumentensis
MGQKVNPNGIRIGYIKNWNSVWYADKKDYSDMLNTDIRIRNFLFKKLNKASVSKICIERPTKNAKITIYSSRPGIIIGKKGEDIEKLRKKISSLMGGISININIEEIRKPELEAKLVAENISYQLEKRMMFRRVMKRSVQNTMKAGAKGMKVSVSGRLSGAEIARTESYREGRVPLHTFRANINYSFSIASTPYGILGIKVWIFTGYIHKEKKNKEK

SEQ ID NO: 48 - protein, 112 aa, Candidatus Endoecteinascidia frumentensis
MQVTAHYNYAKISAQKCRLVANQIRGLSVDKAINILDFSPKKAAFLIKKTLKSAIANAENNENLDIDVLQVSIIYINEGPTLKRFRARAKGKGNRILKRSCHITIKVSEKRE

SEQ ID NO: 49 - protein, 92 aa, Candidatus Endoecteinascidia frumentensis
MPRSLKKGPFVDGHLLKKVLFSIKQKKKKPIKTWSRRSMIIPDMIGLTIAIHNGRNHIPVFITENMVGHKLGEFALTRTYRGHSSDKKVQKK

SEQ ID NO: 50 - protein, 278 aa, Candidatus Endoecteinascidia frumentensis
MSLIKIKPTSPGRRFVVNIKRSCKIYNKKPYKPLLSTKKQKSGRNNHGHITIRHRGGGNKKHYRIIDFKRYDKDNIPAKVLRIEYDPNRSAYIALLRYKDGEYRYIISPQGLNVENTIISGTEAPIKIGNNLPLSNIPVGTILHCVEIKVKKGSQIARSAGSYVRFISREGSYAILRLKSGEIRKILLACRATIGSVSNSEHNLISLGKAGASRHRGIRPTVRGVAMNPVDHPHGGGEGKTSGGRHPVSPWGLLTKGYKTRNNKRTEKFIIKHSKKSK

SEQ ID NO: 51 - protein, 103 aa, Candidatus Endoecteinascidia frumentensis
LNQENPFSLRRILLSPRITDKSYNITKKNNQVSFKVAYWANKKQIKQSIEYLFNVKISNIQTLNIKGKCHKFGRKKIKGYTKKWKKAYATLKKGYKINFIETE

SEQ ID NO: 52 - protein, 209 aa, Candidatus Endoecteinascidia frumentensis
MQFSILDNHGKITKNFFQASDNIFNKKYNKSLIFQVIRSYTMNSHKGTKSQKNRSEVQGGGSKPWKQKGTGKARAGTIRSPIWRSGGVTFAARKTKLSYHKINRKMYKNALRVIFSQLVREKRFFLIDNIPTMHIPKTSVLKKKIHNICTSKNILIIVEKFCEILYLSSRNLSNINICSVSYINPLLLIKYHNVIVTMNSLKMIEEVLS

SEQ ID NO: 53 - protein, 213 aa, Candidatus Endoecteinascidia frumentensis
MAIGLIGQKCGMSHIFNSSGCFIPVTIIWIEPNIIVQIKTKDKDGYNALQITKGSKKRSRINKPLSGHFLKSNLKPGEKLWEFRLENINKEYKVGYAFKVDFFAVGQKVNVTGISKGKGFSGVIKRHNFHSQDSSHGNSLSHRAPGSIGQNQTPGRVFKGKKMAGHLGNVQKTISSLEIMQIDSLKNLIFIKGSVPGTRNRNVIIKPEYLRGV

SEQ ID NO: 54 - protein, 102 aa, Candidatus Endoecteinascidia frumentensis
MSIQKIYIKLKSFDYSLIDFATKDIVNTAKKTGAQVIGPIPFPTKIERFTVLISPHVNKDARDQYEIRTHKRLIVIVASSSTVDALMRLDLAAGVDVKISLR

SEQ ID NO: 55 - protein, 396 aa, Candidatus Endoecteinascidia frumentensis
MAKKIFDRKKPHINVGTIGHVDHGKTTLTAAITKVMSEEYGGEFKDYDNIDNAPEERARGITIATAHVEYESNERHYAHVDCPGHADYVKNMITGAAQMDGAILVVSAADGPMPQTREHILLARQVGVPNIIVFLNKADMVDDSELLELVEMEVRELLEQYEFPGDKTPVIIGSALKALNGDSSDIGKESIKKLVHSMDKYFPEPKRDIEKPFLLPIEDVFSISGRGTVVTGRIERGIVKIGEEVEIVGIKKTKNTTITGVEMFRKLLNEGRAGDNVGVLIRGIKRDEVERGQILCHKGTITPHTKFEAEIYVLLKEEGGRHTPFFKGYRPQFYFRTTDVTGNVKLDDTIEMVMPGDNIKITVELITSIAMEEGLRFAMREGGKTIGAGVVTKILK

SEQ ID NO: 56 - protein, 693 aa, Candidatus Endoecteinascidia frumentensis
MNRLIPINYYRNIGICAHVDAGKTTTTERILFYTGMTYKIGEVHDGAATMDWMEQEQERGITITSAATTVKWKGMLNQFPEHRINIIDTPGHVDFTIEVERSLRVLDGVVVVFCGSSGVEPQSETVWRQADRYKVPRIVFINKMDRAGADFFYVIKQIQERLDAIAIPVQLNIGIEEKFIGVIDLIKMKAIIWNNKDQGLTLKYKKIPSELQEISLQYREKMIEAAAEASEELMDLYLNNGILSEENIKKGLRKRVIKNEICVVFCGSAFKNKGVQSVLDGIIEFLPAPNEVEIKGLKNQNIENSSFSAFAFKIATDPFVGNLTYLRIYSGILKTGDQVFNPIKKQKERIGRIVQMHANRREEIKQVYSGDIAAAIGLKSVSTGDTLCNIENPIILEKMDFPEPVISVSVEPKTKKDQEKMGIALGKLASEDPSFRVYTDKETSQTIISGMGELHLEVIIDRMRREFNIEANIGKPQVAYRETICKIVEHEFKFIRQTGGRGQYGHVFLRLEPQNQGFGYKFINKIVGGVIPKEFIPAVDKGIQEQMLNGVLSGYPMIDIQVTLFDGSYHDVDSSEISFKVAGSMCFKEAAKKANAVILEPIMKVEVISPEKYMGEVIGDLNRRRGIVYNVENQSNRKLIQAEIPLALMFGYATSLRSLSQGRANYTMEFKKYAKIPSHDINKIIENKNVKEV

SEQ ID NO: 57 - protein, 157 aa, Candidatus Endoecteinascidia frumentensis
MSRRREISKRKILPDPIYGSQLLTKFINQIMFNGKKSVAEKIVYNALEIIKNHVKEKTSLMIFESALENAKPIVEVKSRRVGGSTYQVPIEVQVERSKTLAMRWLIESARIRKEKKMEKRLANEIIESFEGRSSTVKKRDNIHRAAEANKAFSHYRW

SEQ ID NO: 58 - protein, 124 aa, Candidatus Endoecteinascidia frumentensis
MATINQLVRKPRKIKKFKTNVPALSNSPQRRGVCTRVYTTTPKKPNSALRKVCRVHLTNGFEVSTYIGGEGHNLQEHSVVLIRGGRVKDLPGVRYHVIRGSLDTSGVENRKQGRSKYGSKKLKN

SEQ ID NO: 59 - protein, 400 aa, Candidatus Endoecteinascidia frumentensis
MISVKDSLKIFRHGSIEILPENELIQKLNLGKPLRIKAGFDPTSPDLHLGHIVLISKLKKLQDLGHKIIFLIGDFTALIGDPTGKNVCRKTLSLEEIKKNVKTYQNQIFKFLDSKSTEIVFNSSWMYKKNALDIIQLFAKTTISRILERNDFWERFKKKNPIFIHELLYPIIQGYDSVKLNIDVEIGGTDQKFNLLMGREIQKNYQQTPQVIITMPLLPGINGIHKMSKSLNNYISINERSNIIFNKIMSISDEKMWKYYELLSMKKIEKIKILKNMCNLKKKNPMDVKINLAKELVMRFFSKKESEKSYLNFFYQFQKKKIPDILPMISINIEREKIFICQALKHANMIKSHSEGFRLIQQNAIKLNTKIVDNPKYILIKNKEYIVQVGKRKINKLIIL

SEQ ID NO: 60 - protein, 48 aa, Candidatus Endoecteinascidia frumentensis
MWFFFFYRGLKKIKSILWWSQGESNSQPSACKADALPIELWPQNGGSG

SEQ ID NO: 61 - protein, 115 aa, Candidatus Endoecteinascidia frumentensis
MDSKKQKIIFTNSAANKVKNLILEENNSKLNLRVFIRGGGCSGFQYGFTFDEDIAYDDMKITNHDVTLLIDPMSYQYLIGAEIDYKSDLNGEQFVIRNPNAKVTCGCGSSFSIED

SEQ ID NO: 62 - protein, 280 aa, Candidatus Endoecteinascidia frumentensis
MKKKSVLYIVSTPIGNLSDISLRAIEILQKVNYILLENLEHGRILIKKFCIKTSIISIHEYNEELKIQWILNKLNIGNSLALISDAGTPLVNDPGYKIVQKVKKNGYKISPIPGPCALIAALSVSGLPTHHFEFIGFMPRKYGEKLLKIQSILEIDHTIIFYESKHRIINTLNMMSKFFEKERLIVLAKELTKKFEKIITGNIDSILEWIKCDIKNQKGEFVLLVEPCRSYKRKEITTDINILISLLHKKLKASDLAKFLSKLTQEKRKKIYKKIILNNI

SEQ ID NO: 63 - protein, 247 aa, Candidatus Endoecteinascidia frumentensis
MKYQKKENILLGVNIDHIASLRESRKTNYPDIIKAAKIIKNSGADKITVHLREDRRHIQDVDVFELVKIFPDCLNLEISISKEMINIAEKIKPKYCCLVPEKRKELTTEKGLDILNNLFSIKMAYKKLHNAGIITSVFIDPNYLQIKCAKNIGLNIIEIHTGYYASSNSYNKKKELQLIKNSIKYAKKLGMIIHAGHGLNQENIHAIASIPEIQELNIGHSIISDSIFLGLKKAILNIKLSIINARK

SEQ ID NO: 64 - protein, 63 aa, Candidatus Endoecteinascidia frumentensis
MNIALKEAKKAYRINEVPVGAVVIENNKIIAKAHNQMIKDNNCTAHAEILALKIACKKKKIID

SEQ ID NO: 65 - protein, 67 aa, Candidatus Endoecteinascidia frumentensis
MCLGAMINARIQSLIYGASNNEIKLFSRESKKILKKIKNRKIGFTIIHNILQKPCSNILISFFKKKR

SEQ ID NO: 66 - protein, 333 aa, Candidatus Endoecteinascidia frumentensis
MKYDVYGIGTALLDIEFLVSSKFLKKNNIYKGITTLINEERKIELLKILKKHSFYCKKKHIGGSLANSLVAINYFKGTTFFSFNAINDSLGKYYIKKIKKIGIHCNKSKNICSQNGKTGNCLIFITEDSDRTMNTFVGTSNELNENNINFDALFQSKYLFIEGYLIASKNTYNLICNIIIQAKLKNIKIALTLSDVSIIDSFREKIDNIIENGIDLIFCNQFEAKAYTKTNSLKKLIFSMKKNCKTFVITFGKDGSIVFDGDNLYKIPANNVKKINTLGAGDVYAGTFLAGITQGVSWKKSAEFATKTSAKIVTRYGSHLLKNDFISNLKLLN

SEQ ID NO: 67 - protein, 224 aa, Candidatus Endoecteinascidia frumentensis
MINQNYLKKKLAEKAIKYIPYGSVLGIGTGSTINFFINELKKIQNKVSFIISSSHISTEKMSSLNIPVNHIQTELPEIDIYIDSADEINSSFQMIKGGGGALTKEKIIATFAKKFFCIIDHSKEVKNLGSFPVAVEVIPIAKNLVIKELKKIGGISKLRKDFITDNGNIIIDVYDLNINNPKKIESYINKITGVVENGIFAYRSADMVLVSTPNGVLKKEQIIY

SEQ ID NO: 68 - protein, 496 aa, Candidatus Endoecteinascidia frumentensis
MNRKVYIRKEINHENEQFNIRKLKLEKLKKTGNPFPNSFKPNIDIKKLKIQYSKFSKKTLQFIKRQYKISGRITSKRIIGKASFYSIQNIEDSIQIYFRKEQSQKNMDKVSWDIGDIIGVEGKVFKTNTGELSLFAESIILLTKSLRSIPNKFYGLLDKETRFRKRYLDLITNKKSQEIFKIRFKIIQKIREYFIKRKFIEVETPMLQNIASGAIAKPFITYHNNLNMKIFLRIAPELYLKRLIIGGFEKIFEVNRNFRNEGISKQHNPEFTMLEFYQAYADYNDLIKLTEDLICNISNSIFGSTIIKYQENIYDFGVPFNKMTMLESILKYLPEVNINQLSDEESAKKLACSLQIKIDKNSTLGKIQADIFEKYIEHKLCQPTFITEYPIEVSPLARKNEKNPLVTDRFEFFIDGKEIANGFSELNDSEDQKRRFLQQINKDPDDQMQFDKDYIEALEYGLPPTAGEGIGIDRLVMIFTNCSSIREVLLFPHMKN

SEQ ID NO: 69 - protein, 122 aa, Candidatus Endoecteinascidia frumentensis
MYFSKKYFNKTLITIKNPDSPYFIINSFDNIIIMNNFKKYYIPVIIFSNKDPIMYDDNIKINFFNIDLILFGCDSQSQNKFNNLLIKLCKQNIGFEITNHKSACRTFNFLLDQGKKVILILI

SEQ ID NO: 70 - protein, 222 aa, Candidatus Endoecteinascidia frumentensis
MKCIIITIFPEYFQQFKEIGVVGRAIKKKIIDLIFINPRKFSSNLYKSIDDRAFGGIAGMIMTPEPIAISIEEAKKELPKAKVIYLTPKGKLFQQKMATKISKNIKSIILLCGRYAGIDQRVLDTHVDEEISLGKFIVSGGEIPAMMFLDAIIRLLPNTLNNKKSILENSFAKKNVINFPCYTRPRIWRGKKVPDILFSGNHKKIKIWKKNKLTKKNYHLKK

SEQ ID NO: 71 - protein, 168 aa, Candidatus Endoecteinascidia frumentensis
MNKLIIIGKIGSTYGLKGKLKLYDFTKIGLNRINKNSWKIKQNQEWKQISPFYLKKYQKNWLIKISGYDYPEIAKNLVNSYIGIKNHINHFPDLPYNEFYYIDLKGLEVISIKGEKYGKILYIIETKANDVLFVQNNKKKRLIPYISNVIISVNLKKKKILVDWPSNF

SEQ ID NO: 72 - protein, 405 aa, Candidatus Endoecteinascidia frumentensis
MKKIHIVFSIFFSIILFGFSENVLDKKNIILYKEQKEKKTINLLYNKSFSKSKILNNKWGKLSIFPPKLLAKSWILMDAKTGQVLIQNNANITFSEKNLPKFMLLYIIENELLQGNIQISDIIKVSSPISWTNEGSRMFILSNVKISVQDLIKEILQNSGNDSSLELAKYISGTTEEYINIMNHVVHNLKMQNTYFFKEKLFNLHNYSSAYDMALLAKALINKIDNNPNHFSKLLTNIYPNKLLFLYFSLCIFKNDPIKLFQYSLVSIEKMKNNPMKLICVVIGNSSIDKNITETKALLNYGFQFFKEKCIYKKNVLIKYVPISLGNQSHIPIGVPYNLILNLPKNYKKTSLKANLIIKKKLYAPISKGAKIGDIEILLNNKIIATIPAISLLSISRIGIWHKIF

SEQ ID NO: 73 - protein, 694 aa, Candidatus Endoecteinascidia frumentensis
MILLSIIFLSFFYKKEILKKLVLIWLYIFKKYRLLQVFIPNELYLLNQKIVIISQEHSIITTILIRFWIGKKVFLINSDINILNILSLFGIYKNFSIENIPSKTIILINQNNINLVNNIKLQYYLYLCGKSKSIGNKNYSFLTLNIKYKKNDFKWKNFVINSWEKHIQKFPPIIHQWINTQNCWNKKISISDDFENKLSGINFITSVWILRKKLFNLLKNENYIGILLPSTTFTVVIFLTLLSLKKIIIPLNYTSGAENIIHAINQTNINIIISSKRFLKTLSNKLFYNSPLKDKKILYLESLKEDITVFNKIISFFLVLILPKYLIKTTLSSKINPKEKAVILFSSGSENIPKGIILTHENLIANCLQSAQSFNISKNDKILGSLPLFHAFGLTISVLLPLITGMPSIQISDPRNIKLTAKLIKKYQITLICTTPSFLRLYIKNIYINFNHLISVKMIISGGEKLQKHISTEFRKKFHKCIFEGYGTTELSPVISVNRKNTNHTIKYKKFTVGLPLEGCFVKIVDPLTYKDLPKGRHGLLLATGINLMYGYLKNKKLFNNLVQIENLLWHCTGDCASIDNDGYITIHDRYSRFAKIGAEMVSLSFIENAIYKNIDNNTLAEILIISIPDKKKGECLYLIHNKEITENDIKKAIKNSDLPNLFKPKLFYKVCQIPKLGNGKIDLINAKKLINLT

SEQ ID NO: 74 - protein, 287 aa, Candidatus Endoecteinascidia frumentensis
LNYSGYLTVINTINPSKSVDSYIHFANSISLLTEEEEFYCAENFKKNNDLYSAQRLIMSHLRFVIKVAKGFNGYGLQLSDLIQEGNIGLMKAVKRFNHKLGVRLVSFAVHWIKAEIHEFIIRNWKIVKIATTKAQRKLFFNLRNCKKHIGWFSQKEIQDVADTLKVKTTEVIEMEKRMNTYDQTFDLLQDYDQEFSYHLYPNQYLTTDDNDIVDIIHQENIKKIQKKSLKLALNCLDKRSKFIIKNRWLKNKKTTLHDLAKKYLVSAERIRQIELQALEILRQKITY

SEQ ID NO: 75 - protein, 172 aa, Candidatus Endoecteinascidia frumentensis
MTGLNIKFNHIIEISTIITDQYLNIIDEGPSITIFQPKENLLSINKWSMHQHTKSGLLDKVVRSRVSVKEAEEKTINFLKKNNIKKGCSPMCGNSVYQDRKFLAKYMKNLDSYFHYRLLDVSTIKELVFRWYPNLKIFKKKKMHTALYDIKESINELKFYQKHIFIPIKKNI

SEQ ID NO: 76 - protein, 245 aa, Candidatus Endoecteinascidia frumentensis
MKNEEYIYGINPVLSYLRNNKSGKKIWIFLQKKYNRKIQTIINISKKMHIPIILLSKNNSRFQKINHQGIILLKNEQILFNNSIENLLNDITKNTLLLVLERIQDPQNLGACLRSAAAANVQAVIISKFQSSPITQTVRKVSCGSEKFLNIYIVKNLSSVLKKLKKSGVWIIGLTPHASKIIYQINFKIPIAIIAGNEGTGLRNITMKYSDYLTKIPILNSTIESLNVSVSIGITLFEIIRQRMY

SEQ ID NO: 77 - protein, 66 aa, Candidatus Endoecteinascidia frumentensis
MLHITTEDCLHAVDNRFQLVILAALRSKKILLSGEEPLVSWNKNKVTVVALREISKNKINNSYFNL

SEQ ID NO: 78 - protein, 206 aa, Candidatus Endoecteinascidia frumentensis
VILSNIIVIISSPSGCGKTSISQELLKKNKNLVSTISYTTRTPRKKEQHGKDYYFISLKKFKKLKDKNFFLEYAKIFNDYYATSKSELVNLLTKGHNILLPINWQGAKKIYCMFPKASITIFLLPPSKKELFNRLKKRGQDSEKIIHQRMEALQDEISHFQEFDYTLVNKCFQKTCQNIQYIIESELNKTYRSIILKKKFLLKLLS

SEQ ID NO: 79 - protein, 173 aa, Candidatus Endoecteinascidia frumentensis
MCKKNSDNIIKAIIEIPAFSNPIKYEFDKKNNILMVDRFISTTMQYPANYGFIPKTLSRDKDPMDILVITPFPLQHGVLIHCRPIGILNMNDESGEDIKILSVPISKLTPIYNHIREIEDLPILLIKQIEHFFSHYKDLEDNKWVKIIGWGNSKKSFSSIEDGMKNYSLNFKK

SEQ ID NO: 80 - protein, 117 aa, Candidatus Endoecteinascidia frumentensis
MNTYRFITEFEQKQIHKKLPKFSSGDTVIVKIKIKEGNKERFQLFEGIVIAKKNRGFNSSFTVRKIVSGEGIERVFPSYSPLIADIIVKRRGDVKKSKIYFLRNRKGKSARIKEKIS

SEQ ID NO: 81 - protein, 578 aa, Candidatus Endoecteinascidia frumentensis
MRRIKKLSKKIISQIAAGEIIERPSSIVKELFENSVDSFADCIDIKIYQGGISKIIVTDNGNGIHKDDLQKITRRHHTSKIYTKKELENILSLGFRGEALASIASVSYFSLISRQDNNNYAWKISTIGNNKNKIIIPAAHNIGTTVEVCSLFFNMPVRKKLLKEYNEFLHMSKMVKKLILSHFNINCRFFHNNKIIYDIKASNTETEKSNRIKSLFNENFISNMLKINYQIKNLKLWGWIGLPTFSQISKDQQYFYVNRRIMKNKIINSIIRIAYRGLIYRNQNPVFILFLEINENLLNINISPKKNEVHFQEKEKIQDFILKSLEKSLKKTNPKESLKNQYISNIDLHTLKKKIVISNFLKNNFKENYSLNSLNKNKNLDIYHFPPLGYAIGQFYGTYILSQNQKNLIIVDIHAAHERIFLEKIKKLWKLNSIESQLLLIPIILSVSDKEFQYIKKFNSKLNKIGIGLDLTNNNIVSVKKIPTFLKTKNIYFCIQDIIKDIIQYGNIVENDFFFQKILSTISCYSAIKSNQKLSISEMNRLLRDMENSEKSNQCNHGRPTWIMISAKYINKIFLRNF

SEQ ID NO: 82 - protein, 328 aa, Candidatus Endoecteinascidia frumentensis
MVSHIEMTWKQQLKNSYSNIDDLLQFLKLDGTKFNIDKNSKFPFKVTQHFANQIEKKNWNDPLLKQILPIIDEKKKVLKYILDPLSESKANILPGMLQKYSSRVLLIVTKSCAIHCRYCFRKSFNYLANQINKKQWKIVFKYIKKNKEIYEIILSGGDPLMLNDEHIKYFIIEISKISHIKILRIHSRLPVVLPDRLTESLLYALHKFPYTIVLVIHANHANELSKSVIYKLIKYREGGLILLNQSVFLKGINDCQKILSDLSKKLFKAGVLPYYLHILDPVEGVSHFKESTKKAKKIIEIMRKSLPGYLVPRLCKELSGKSSKTILM

SEQ ID NO: 83 - protein, 196 aa, Candidatus Endoecteinascidia frumentensis
MFNYQKAFYLTSSKNYKFLPKDLGIEIAFLGRSNAGKSTIINTLTQKKNLAKSSKTPGCTNLINLFQLDKIRRIVDFPGYGFTKSSTKKLGKYFEIYLEKRKSLKGVIIVIDVRHIQMPMDIHMVKWTVSSDLPCHIILNKSDKLNIYTRNKMLKLANSFYNKENNKIITMQLFSNKIKTIGLKKLKNILNKWYHI

SEQ ID NO: 84 - protein, 402 aa, Candidatus Endoecteinascidia frumentensis
MNIYSEIGLLKTVLVHKPNITLKYITPDNAEYLLFDDVLWTDLTIKEHDYFTDVLKEHGVNVLVVGDLLQDILNKDNAKRWLLNNLTKKYYPSLFLEDIKNFLNQQNSYNFMSYITGGLTFEQLKCEKSKNNLISQVFKKNDFVLNPLPNHLFTRDTSCWIGNGVTLNSMCYPVRYNETINIAAIYKFHPFFKNKNFDIWYDIISDKFLPSLEGGDILVLNKRTLLIGFSERTTLLAIEILAKKLFLSTTFNKIIVLNLPKKRSCIHLDTLLTMVDVNCFCSAIPDKLHTWIIQPGNKKNIHVSYSLNPKKEISQSFEDKNIRFIEIQGDFFSRKQEQWNDAANVLAISPGNVIAYNRNINTNLALKKAGINVIEIPGSELIRGRGGPRCMSCPIEREEISL

SEQ ID NO: 85 - protein, 299 aa, Candidatus Endoecteinascidia frumentensis
MKKIVIALGGNAILSRQDKLEAHIQIKNIKNAVKAIAEIAKKNQVVICHGNGPQVGLLAIKDEQYTSVSPYPLDSLVANTQGMLGYWIQRELKNFLPQKEILTILTQVVVDSKDPAYKNPTKFIGPQYSLNKKKELQNRGWKLGIDNGKIRRVVASPKPKDIVEIQSISSLLNHKNIIICCGGGGIPVIQENNILSGIDCVIDKDHTSSLIAQLINADFLLILTDVKGIYLNWGTDKQKIIKNISIKNLMKIDLNKGSMYPKAKACYNYIKNTKKYAGIGHLKDAFDIFLGKKGTQIHI

SEQ ID NO: 86 - protein, 494 aa, Candidatus Endoecteinascidia frumentensis
MKKLNNKNLPIVWSIAGSDSGGGAGIQADLKTMNILGVHGCSIITASTAQNTVSVTDIHNIPLNHISSQYKALKKDLPAKAIKIGMLAKGNIIKKIFDLLSNIPNIPIILDPVMISSSGSLLLDFNSIEMIKKLLFPIAELITPNLFETEILCNRKIKSIIDVEKSAEQILENGAKSVIIKCGNNNKFWASDFFLDKSKKYWFNIPKIQNIQTHGLGCAFSAAIASARALDFDLKSSVVLAKMFITQGIRLSKKISLYGYTPINNVSYPKFEQDIPLVSNIPISKIPQSFSRYKNTNNNIELYPIVSSLQELKMLSETGCTIFQLRIKEIKSQKKLEEEIFNAIKFAKFKKIKLFINDYWKLAIEMQAYGIHLGQDDITTADLNLIKNKNIKLGLSTHNFFEIAIAHYIKPSYISIGPIFPTKTKVMPYKEQGIERLKYWKSVLDYPIIAIGGINKKNIHLVKETKISGISIISGILNAKDPILETKKIQKLIS

SEQ ID NO: 87 - protein, 258 aa, Candidatus Endoecteinascidia frumentensis
MWKIGGKKLKSRLMLGSSLYPSLEIMKKSIKESKTEIITVSLRRQKKENQVFWNILKKINCIILPNTSGCFSIKETILIAKMAREIFETNYIKLEIIGDDYNLQPNPFLLLKATEKLISMNFIVFPFCTDDLVLCNHLVNLGCDILMPWGSPIGSGKGILNTESLKTLRKRFPEINLIIDAGIGKPSHAMQAMELGYDGLLINSAIALSHNPIKMAKSFSLAVKSGRMAYKAGFMPERSFASPSTPILGTPFWRKNKK

SEQ ID NO: 88 - protein, 66 aa, Candidatus Endoecteinascidia frumentensis
MIPIILNGKKININSEMTISNLLSVNKIKGSFAIAINMNFIPKNTWNNTKIKANDNIELIAPMQGG

SEQ ID NO: 89 - protein, 333 aa, Candidatus Endoecteinascidia frumentensis
MKIAIIGAGIIGRLLSWRLLRYSTNQISLYDKEYKNINNCSMTAAGILSPFSELDKLDSTILNLSINSLNLWDSYLKELKKPIFFQKNGSIITAHQQDIDTLSHYIKYIEKYTKNKIQILTKQELKKLEPNLNMKYAYWLPKEGQIDSQAFMNYMGELLPKYINWYEKIEIKYCIPHEVNGKQYDWVIDCRGLGAKEELSELRSIRGELIWIHTSDISFMRPIRMIHPKKSIYIVPRPKNIFILGSSEIESYDFSPISVRTTLELLSSAYSVNSSFLEARIIKTATQCRPTLPNYSSNLIIHKNGLIRVNGLFRYGWLVAPPIVEKIIQHIFK

SEQ ID NO: 90 - protein, 98 aa, Candidatus Endoecteinascidia frumentensis
LIKINLNIKFIIFFYKKNMQNYIYCQKLKKKLPALDIAPYPGNLGKKILKHISSKAWEMWKNQQTILINEYRLNMLDKESRLFLLKKMNIFLFGEYKK

SEQ ID NO: 91 - protein, 342 aa, Candidatus Endoecteinascidia frumentensis
MKKKFSNLILHWYRNHKKRIFPWQKNKTLYRVWISEIMLQQTRAITVVPFYKKFIIYFPEVIQLAKSSEEEVLSLWSGLGYYRRAINLLNSAKIITSRYNGIFPNKFEILVTLPGIGKSTAGAILAISQNQRYPILDINAKRVLYRFFGIKKNFSSSKIIKKLWNLSEELLPYRYISEYTQALMDIGAIFCISKPKCLSCPLNQDCLSKKRNILSIKNYKNKKKKVRKVIFLILKKDKRVLLIKRPKKNFWPGLYCFPIFNTYKNFKHFINIKSYKISFSFPLKKHKFSHFELNYQAIICNLKIFPLSGDARFLEIKEALKLGIPSPIKKILSSQDLINKLN

SEQ ID NO: 92 - protein, 179 aa, Candidatus Endoecteinascidia frumentensis
VENLFKKIIIQIGENTNRKGLKKTPIRAARAIRFLTQGYQIKLQDILNDAIFSAETNSMILVKNIEFYSLCEHHLLPISGRCHIAYIPKKKIIGLSKIPRIVDMFCRRLQMQENLTKEIACCLESVIKPQGVAVVIEGKHFCMSMRGVKKQFSVMTTSLMLGLFQNNYHIREEFLHLIK

SEQ ID NO: 93 - protein, 203 aa, Candidatus Endoecteinascidia frumentensis
MKKNFFLYLLEFIFNKFLILESDVEILINPLINTKVLLNFTDLQYSILLIPKKKKFLFYNMDYNSYSSYKENYNIIDLVLESDIFGYIQFIKINNLQLKTFPKRIKFFGKIHILQAYKLFFQQINLDIKLFLLNFLKIKGIYIPYLPKIKTNVLKKISLNVEEFLQEEIKISPSIKEVKNWFDNVIIFRQNIDKLESKIINDL

SEQ ID NO: 94 - protein, 249 aa, Candidatus Endoecteinascidia frumentensis
MKNFNNYFGFTKLSSIEKKKKIMDIFTSIHKKYDLMNDIMSMGFHRLWKKTAIQMGNISPDDLILDLAGGTGDLSLNILKILSNSGHIILSDINEYMILEGRIRIENKGYISNISYAIADAESLPFAKNTFNTVLMAFGFRNIENKEKALSSIFNVIKPGGCLIILEFSKLADSFIIKFLYNIYLSYIIPYLGKFIANNEKAYRYLSESIYQHPDQESLKKMMIKIGYKKVQYINLSKGIVSIHKGLVF

SEQ ID NO: 95 - protein, 420 aa, Candidatus Endoecteinascidia frumentensis
MIFKKNLFISDPDIFYAIQNEQKRQEKYLELIASENYVSLEVMEAQGSVMTNKYAEGYPNKRYYGGCKYIDIVENLAIARLKKIYSAEYVNVQPHSGSQANAAVYFSLLNTGDTILGMKLDHGGHLTHGSTVNFSGKIFNSIQYGVNIDTGLIDYSQIESLAYENKPKMIIAGGSAYSRIINWKKIRKIADSINAYFFVDMAHIAGLVAANLYPNPVEIADVVTSTTHKTLRGPRGGIILCKKNTEVSKKINSMVFPGIQGGPLMHVIAAKAVSFKEALSLSFKDYQRQVIENAKKMSKVFIERNYHVISQGTDTHLLLINLSKKKITGKKAEEALEKAHITVNKNTIPNDPQKAFITSGLRLGTPAITTRGLRTSECELIAHWISDILDDIQNNEKIQNIKKLVDKICQKFPIYKKYLR

SEQ ID NO: 96 - protein, 86 aa, Candidatus Endoecteinascidia frumentensis
LADTKQSKKRIKQSEKNRKKNASALSMLRKKIKSVISAISNKNKENAFIAYKKMEKILDKFSRKGLIHCNKSARYKSRIFRKIKNL

SEQ ID NO: 97 - protein, 67 aa, Candidatus Endoecteinascidia frumentensis
MFLIKKTHIFLKKKIKSIVFSTLENMNFVGKENFDMQKKILISACQKLEVLEKKVEKIIQNRNNIKL

SEQ ID NO: 98 - protein, 780 aa, Candidatus Endoecteinascidia frumentensis
MEAVNLKFDFLKMSFQEILEIIQKYKLSITVKEAKKMQTLFQKFPSLSECILWGIHRSEHCSYKSSRIYLNTLPKKSPNILLKKNEDAGIISIAYAKENKEYYGIAISHESHNHPSQIVPFEGAATGIGGNVRDVCCMGATVIANADSLRFGSLYNNKINSSWIYENVINGIASYSNALGVPNIFGDVQFDSRYNNNCLVTAITIGIVKKSEIIHSYLPKNSEDYDIILVGKKTDASGFGGATFSSINLKKNQKDCSAVQEPNAFLGRILLQSNYELFKKIVSLKKIKDVAFKDLGAGGIACATSELIIDSEYGAEIYIDKVHVLSKKIDPTIILCSETQERYIWACPSELTSKILQHYNEEFELPKISNGACARIIGKINKKKKYRVKFKNHLLIDIEVKNLKKEIFYNKNIKKPILKFTEPKILSKDIVKIWIKIISHPNVSSDIDIFERYDKQVQGRTLIERGNADSGVFIPFNGTDFPESIRNIAIALSVSGNPRFGKIDPYWASVNAVISSMGSIISVGATPEGITDCLCFGNPENPENMYELVNSIKGIKDVCENIHLLRYPSFPTPVISGNVSLHNVFQEKAIPASPIISCIGRIENFKKTINRSFKEINNFLILIGDRKNECGGSIYYEVFDELGKNIPKPDFILMHKIFKWIHKQISDNNILSASWIGNGGLAATLTRMSIANEIGFSIKLPGKYNKKIELFSETPGFLLEIHFSKLKFLENFAKKMNIPFFILGNTIQEKKWYIEKNINIDLIYAKKIWFHSLKKLLLTS

SEQ ID NO: 99 - protein, 348 aa, Candidatus Endoecteinascidia frumentensis
MKEITYKDSGVNLKLGNFTISRIKPIIHSTFNNNVISHIGTFSSIFDLKNILNIYKHPLMVQSMDGIGTKSIIAKMANQFYNLGIDLVSACSNDILTLGAKTLTLLDYISTSKLNSHIVEEIVKGMVDACKKENIALVGGELAEMPGIYIKGEYDIVGIATGIIEKEKIINGNQIQIGDKIIGFLSNGLHTNGFSLARKLLFDIKKFRIHQYIKKLGKTLDEVLLEPHINYSKLIHKILKKEIFIKGMAHITGGGIIENIPRILPFGCGAEIKIHSWPIPPIFSFLCQIGNLSKKESYSTFNMGIGWIIILSKKSLAQLKKKCKDISYFVIGKVIQDKHNKIYLKEIL

SEQ ID NO: 100 - protein, 426 aa, Candidatus Endoecteinascidia frumentensis
MKKIGVIQFPGSNCERETKLAIERSGMQAISFLWNYKTVSFDIFDGFVIVGGFSYEDRCRSGLIASKDPLLSKLIIEIEKGKPVLGICNGAQILIESGIVPGIKIQDSYKLSVALTLNEKINKKGKILGIGFYNTWCYIDIKNQKNIAENAFFQKKFSKPIRIPFANAEGRFILKKSTFNLLKSSGVMVWKYVNSIGNIKRYYPINPNQSMENIAAISNFSGNVLAMMPHPERTTDGDIIFASIRTYLEKKKIFLYKTFKEKKKIKQLKNYTLPESRYQFLIKMIITDNESISIEQTLKNLGIYCTIQKYQHLEIFSKKIDYKKMYELLYNNHAFYNPKKEYLITKIKLLKKSIKILVRKNTVFNQYKLNILHKKYSLNEIFDIKYGIFWNIIPKNYQEIDYIKKYLLHNSILYNPIAYKAYFYEE

SEQ ID NO: 101 - protein, 289 aa, Candidatus Endoecteinascidia frumentensis
VVSKTNLPYPKFQGKTRDVYDLGDNTLLIINTDRISAFDSNISNIPFKGKIINQISSWWFEKTKNIIPNHMISISSLNEMRVKKCKVFPIEIVVRGFITGNTKTSLWNLYQSGVRNILGKKLPNKLIKNGKLPFPIITPTTKSHISDKPLLNIKDIIKNNFPSEEQWNFISKKSIELFLFGQKIARKSHLLLVDTKYEFGIDNQNNIILVDECHTPDSSRYWKFKDYQKHFQKGKEIKNFDKEFLRKWYIKQINPYQEKKILDIPEEIKIEISYRYIQLFEKLTGKSFF

SEQ ID NO: 102 - protein, 484 aa, Candidatus Endoecteinascidia frumentensis
MCGIVGIISQNPVAFDLYDSLIHLQHRGQNSAGIMTCNNYFYSHIKKGLVQEIFNKKILNKLSGNTGIAHVRYPTSGNLNENESQPFRLSTPYGISLAHNGNLVNRLQLTKFLKNKCLRHLNTDSDSECLIHLLANSLIKKTVKNNSDNFFKKLCDGIKIIHKYVEGSYSVVSNIIGKGLIAFRDPKGIRPLVMGIRKNNMNNKNKYDVIFSSENSSFFSLGFNKIDDVKPGEIIFVNFSGKIFRKILSKEKFQPCIFEYVYFARPDSKLDDVSVYRARLRMGQNLAINWRNTYPKLIPDIVIPVPFTSNTAALSFANEMKVRYSEGLYKNPFIGRTFIMSENKLRKRSVIYKISPQPTEIRGKSVMLIDDSIVRGTTSREIVNMIRECGASKVFFASCCPPLKYPCFYGIDIPTYEELIASNKSFHEIKKYMNVDALLYQKEEDLVEAIDRRGKYHIDSPCMACLNGKYICKKKSKDLNNAIK

SEQ ID NO: 103 - protein, 303 aa, Candidatus Endoecteinascidia frumentensis
MFGKDIISIANMDVHTIQLILKTAKNFKLFPRNSYLKNKIIGSCFFEASTRTRLSFDTAIYRMEGKIIGFSDIDTTSAGKKGESLSDTIQVISSYTDAIIIRHPCAGSAKLAADISSKPVINAGDGGNQHPTQTLLDLFTISESQGSLEELNIAMVGDLRYGRTVHSLSQALSHFNTTLFFVAPKSLSMPDSVCNFLNEKNIKFSYHENMMEILSDLDILYMTRLQKERFEPTEYHEIKQQFILKPHMLMNTKKNLKIMHPLPRVGEIDKNIDIMKQAYYFQQASNGVEIRQAIIALLLKEIL

SEQ ID NO: 104 - protein, 157 aa, Candidatus Endoecteinascidia frumentensis
MNNYTILSVTAIKQGCVIDHITAGQGIKILQALDLLKLKYQITVGLNLPSKRKVLKDLIKITNFYILNATISKIGIIAPGSTINEIKNYKVKKKYMLKLPNIVKGLFICPNTQCITQTESLESYFYVLFKKKEKDVKLICRYCETFFDKNILENIHY

SEQ ID NO: 105 - protein, 299 aa, Candidatus Endoecteinascidia frumentensis
MYDSLINSKKEIDNPFFNECLSRIQNTLIRILNSKKINKKNHILLNAISYILLNGKKIRGLLDYATATSIGIPIEHCDISACAIEMIHAYSLIHDDLPSMDNDMKRRGRDSCHIAFDESTAILAGDSLHSLAFEILSDSNPGISDHKKIQIIHTLSKAIGIKGMVLGQYLDINNFVSLKYKNKKKLDIIYNFKTGNLIKASVKIGYLKKNKLDKKYKKAFDKFSYHIALAFQIQDDIIDSLKDNQNISKNTYPKILGIKKSIFYIKNHFNCALKNLNLIPNNHKLKTLTKYIILSDFLE

SEQ ID NO: 106 - protein, 373 aa, Candidatus Endoecteinascidia frumentensis
MSNQKDYYEVLGVKKNASNTELKRAYRRLAMKYHPDKNPGDTEAEEKFKEANQAYEILSDSKKRAAYDQFGHSGVDTSYSSFNSGNTFNEVFGDIFGDIFNEHSHSRKRSYQKGSDLKYTIQINLEEAIHGVITQINIPRLVLCQICKGSGSKKGYSKINCATCHGQGNIRMQQGFFSVQQTCPDCHGQGKVIKYPCTLCYGKGRIQRYKKLSVKIPPGIDEGDQIRLVGEGEHGPQGSPSGDLYVQIQIKSHHLFKRRGNDLICEVPLNFVIACIGGIIEVPTMDGKIKLKIPKETQTGKLFRLRGKGVKEFRGNRIGDLLCKVSIETPINLDKDQLKILKNFGSTLHNNTKYTPRSFSWFKGVKNFFSKKK

SEQ ID NO: 107 - protein, 645 aa, Candidatus Endoecteinascidia frumentensis
MGKIIGIDLGTTNSCVSVMDGKSAKVIENSEGRRTTPSIVAIDKEGKIIVGDPAKRQSLTNPKNTIFAAKRLIGRKFDGDIIQKEILPKVPFQVVKANNGDAWIIFNEKKQAPPQISAEVLKKMKKTAEDYLGYEISEAVITVPAYFDDAQRQATKDAGRIAGLNVKRIINEPTAAALAYGIDKGKKDSIVAVYDLGGGTFDISIIEIAKIEGDSQIEVLATNGDTFLGGEDFDLRLMNYIVNEFKISHGINLKQDPLALQRLKEASETAKIELSSNEQTDINLPYITADSSGPKHLNLKVTRAKLNSLVEDLIHRTIEPCRKALKDADRTIQDITDVILVGGQTRMPKVQEIVKEFFQKKPRRDVNPDEAVAMGAAIQGGVLSGDVKDVLLLDVTPLSLGIETMGGVMTKLIERNTTIPTKKSQVFSTADDNQNAVTIHVLQGEREIASSNKSLGRFDLTGIPPAPRGVPQIEVTFDIDANGILNVHAKDKATGKKQSIVIRASGGLSENEIEKMLKDAESNSAKDKEFHKLVLVRNQGDNLLHTTRKSIKEIGDKISSDEKNKIEIACNELEKSLKTDNKTDIEEKTKILTQYASKLTEAIYKKENINTNSSSSSSTQEKEKKSSNEDIVDAEFEEVKDNEKK

SEQ ID NO: 108 - protein, 192 aa, Candidatus Endoecteinascidia frumentensis
MSEKIISKDLHSKKISENCLDTSAKENIHAQKIKELQKELEVSCLKNIKFEEKYKKYRDQALRAFAEVENIRKRTSIDLEKSHKFSIAKFANSLLPIIDSLEKTLELSSKKSEISVIHDGIKLTMKIFIDIMNKFGISQINPIGECFSPNFHEAMSIIKNPKYESNTVVKVYQIGYILHGRLLRPARVVVNK

SEQ ID NO: 109 - protein, 821 aa, Candidatus Endoecteinascidia frumentensis
MNNIINKESLKNKNNNYTSANIKVLKGLDAVRKRPGMYIGDTDNGTGLHHMLFEIIDNSIDEALAGYCDSISVILHNNGFVSIIDNGRGIPTDIHFEEKKSAAEVILTMLHSGAKFDDSSYKISGGLHGVGISVVNALSEIFDLTIYRDGYIYHQIYHLGYPEFPLKKIGKTKKHGTKIYFKPEYNFFKNILTFDFSIVSKRLRELAFLNSGIRLDIEDKRDNQRQTFFYAGGISSYIRYLNIGKDTIHKKIFYVHEKKNKLIMELAMQWCDSLEEKILCYTNNIPQKYGGSHLSGFKTALTRTLNNYIEKEKILRKDKIVTIGEDTRVGLTAILSIKIQDPKFSSQTKNKLISSETKTIIDSLVSQKLFEFLEENPREGKIISEKIVHTARIREAARKIREIAKKQNTIEIAGLSGKLSDCQEKNPESSEIFIVEGDSAGGSAKQARDRRNQAILPIKGKILNIEKASFDKMINSSEIGDLITALGCSIGKNKYDPNKIRYHKIIIMTDADIDGSHIRTLLLTFFYRQMKDVLERGYIYIARPPLYRIKGERKEKYIKDNNDLFKYLIGIAIEKTKLITFIEKEKKIIQGLELERLILKTKKTERIIKKLSKNYPKEILESLMYFKKISSTDFMEKKYLENIFYALESNLNKKSHLGKKYFCYIKECEMKETFIPIIKVIENGFHQKFPIYANFFDSFEYQWLIEQGMILNKFIKKDLSYIQYKNQKYPIKNFYNTIDWLLQESRKGKYIQRYKGLGEMNSHQLWETTMNPKTRNILKVNIKNNSQADHLFYTLMGNHIELRKDFIKKNMLNINLQELDI

SEQ ID NO: 110 - protein, 368 aa, Candidatus Endoecteinascidia frumentensis
MEFKIQRDSFLKGLQTIIGVISKRNTIAIAMNVFIQLKNNILFITATDFEIEIATKIVVLSGKDGSTTLSAKKLLDICKNLTEKSEIIFILDKNKNQGIIISNQTSFKLCTTPIKEFPNMKNIKTIQILKISSHLILFLFKKTYFSMAKKDVRYFLNGLLFEIGNNYIRSIATDGHRMAVSSIFIKNNEKNKKKIIIPRKTVLEIIRLIHKEKSEINIFCSENHFKIETANYSLTSKLIEGNYPDYNSIISADFKNILTVESDLIKSSLNRISILSDQKYKSVRMYISNNSLSLFAKNLEQEIAKDKLKILYQGKSIEIGFNINYLLDVLNVIENDTIQILFTDSYHSVLIKDKKNINNIYIIMPIKL

SEQ ID NO: 111 - protein, 44 aa, Candidatus Endoecteinascidia frumentensis
MKRTFQPSNLRRKRNHGFRARMSTKNGRLILNRRRAKGRKILSA

SEQ ID NO: 112 - protein, 116 aa, Candidatus Endoecteinascidia frumentensis
MSYKFSRRNRLKKKQYFQLFNKINNKYIDKYMIFIYQYTKDISQLGLIIKKKYVPSSVCRNFYKRLVREYFRLHKDKIKLKVIIIAKKNLYKCNKWEIKKCLQKFWQYCMSMQTLE

SEQ ID NO: 113 - protein, 72 aa, Candidatus Endoecteinascidia frumentensis
VFIFFIRIYRLWSIFSYPRCRFYPSCSKYAIDAFQNYTVLYSLYLIFRRLMKCHPFFWGELYDPIPSEKKIK

SEQ ID NO: 114 - protein, 540 aa, Candidatus Endoecteinascidia frumentensis
VNIRFIRNILLILLFLILSIIYYLWQSFDDTIVKKKYILSKNITENSKQKKEYLTKKYNNTDYFQYPKIRIKTDVLDINLNLLNGNISYAALLKYPNKLHSKNPIVLLDNKGNKYIAESGIYSEKIPEKIIFNTKNNKNFYKLIPKEKQLKVNLYWKKNKISIIKEYIFTRGKYDIIVNYIIKNDTQKPFTVKFYNQLVRKIPDKKKNFFFSYSNDMETAISTSNEHFQKITFKEISKKNLNLISKGGWIAMIQHYFISAWIPNTKQENLFYTKDLGNNIYCIGLENSKNTVYSNSKIFNFSKIYIGPAKSDYLASVAPHLELTINYGFLWFISLLIFHTMSWIYNIVGNWGWSIVLVTLLIKLIFYPLSAKSYRAMAKMRNLQPKIQGLKDRLANDKKALGQAIIELYKKEKVNPLGGCLPILIQIPVFIGLYYMLVYSVELRQAPWAFWIHDLSVKDPYYILPIIMGISMLIQQKMNPSNSVDSLQEKILLIIPIVFTLMFLSMPSGLIIYWTVNNFVTILQQWYIINNINNKSNVAK

SEQ ID NO: 115 - protein, 452 aa, Candidatus Endoecteinascidia frumentensis
MLQNDTIVAIATAPGRGGIGIIRISGNNVLSISKILLKFYPKNRYAHFCKFYDQKNNIIDEGIALYFSKPNSFTGEHILELHAHSNPIILDKLIAIIINTKLARIANPGEFTERAFLNNKIDLTQAEAIIDLINANSEQATKSALYSMQGEFSKKINILLQNLINLRMHVESSIDFSEEDIDFIENPKIIEKLDFFIQKIEEILSQSKTGILLKEGLYLSIIGKPNAGKSSLLNALSGRESSIVTKIEGTTRDIIRENILIKGIPIHIVDTAGIRDSNNLIEKKGIQKALIEIKKSNHILLVIDIQKERNHQKSIDEICSLIPHNIPITIILNKCDLLNLKPKFIKIRNKEGLIFSTKKNVSLEMLRKHLLKTVGYNQTVEGNFLARRRHILALENVKNKLLKSKKKFLYNPSIDLLAEDLRKSQDYFNEILGKFTSDDLLKKIFSEFCIGK

SEQ ID NO: 116 - protein, 627 aa, Candidatus Endoecteinascidia frumentensis
MSIKKYFDVIVIGGGHAGTEASIASAKLGSNTLLITQNIDTIGQMSCNPAIGGIGKGHLVKEIDALGGVMGIAIDFSGIQFRILNSRKGSALRATRAQSDRFWYKYKIRSILDNQNNLKILQQEVEDIILNKTKEKILGVITKMGLKFYSSSVVLTTGTFLGGKICIGNKQYIGGRFGDAASNILSKKLRKMPFKIGRLKTGTPPRIDGKTINFSVMEKQKESVKNAHFSFINNGYYNLKQISCYITYTNENTHKIIKENLHYSSIYSGNIIGNGPRYCPSIEDKIVRFKDKLYHQIFIEPEGINTTEIYPNGISTSLPCSVQNDFIHSIKGLENAHIIRYGYAIEYDFFDPRGLHHYLETKCIKGLFFAGQINGTTGYEEAAAQGLIAGINASRLSKNNSFWFPKRNQAYIGVLIDDLVTLGTKEPYRMFTSRAEYRLFLREDNADDRLTPIGKKLGLVDKKRWEIFQKNHNILIYEKNRLKKTFIHKNTLQEKKISSFIKNKIQHEYSLEELIKRPEIDYSILMSLKGLGPGIKNLKLIEKINSSIKYAGYIARQNIDIAKVKHNESICIPKNINYKKIKGLSNEVIEKLNIIMPKTIRQAMRISGITPVAISILLIYIKKLNSK

SEQ ID NO: 117 - protein, 86 aa, Candidatus Endoecteinascidia frumentensis
MFFKKSSIFSIGKIYRIKGFSNSCNSSYRRKFFSLGFIPNSTFEILCIAPFGDPIQIQIKKLLLSLRLKECKYLVLEEVRFLNEYN

SEQ ID NO: 118 - protein, 799 aa, Candidatus Endoecteinascidia frumentensis
MNIISIIGNPNTGKTTLFNMLTGKNERVGNWSGVTVEKKTGVSIINSKLYKIIDLPGLNSFSSNTKHISIDEQITCKHLLDNKFDIIINIIDFSHLENNLYLSTQLLEANIPMIIVINMHNIVMDLNVEDIKKISKLTKCPVVIMSSNKKHSIDLIKKNIQKLINQKKYKIYRTEYSIKFNLIIKKIYQYLKNDFLLKDKNINYYWIIFRFLEKDQLIRKILKLEEKTILKIDHAISKLEKSLETESDFYLANQRHKKTYNWIQQTKKLKDNKKHFFITKKIDTIIINRWIGIPVFLLIMYLIFQCTISFGGAFQPIFDTISRIIFVQGIENIGHTIGLPIWIITIFSRGIGLGLNTVITFIPQISILFFMLSFLENSGYITRAAFVMDKIMQLVGLTGKTFLPLIIGFGCNVPGIIATRSLESKKDRLLSIFISPFMSCTARLSIFAIFSTAFFHKNAPFIIFSLYFLGIFIALLTLIILKLTFLKAQEIPFILDLPLYRFPNIKHLFLDSFVRLKNFLFGAGKTIIPICMLIGLLNSFQWNGRVVPEEKVSSSILSDIGKTITPIFYPIGISYKNWPATVGLITGILAKEVVIGTLNTLYTSNNMNIALSIYDKNKTKEKKYISNFQFEIFHALKETKNNIIALIPFISSNSILSSDENYISNTAIGNMITFFKTPLASYSYMIFILLYVPCISTIATIRREVNFVWSILSLTWSLVIAYSVSVIFYQLFSIKEHIAISVYWIISMLIFLTFIIFIIKKIANNYINASKLNINSEILNCKNSKKCKNCHKNFVIRSI

SEQ ID NO: 119 - protein, 400 aa, Candidatus Endoecteinascidia frumentensis
MIKYINFLQKKKSLQILSGILLIFCTLISLILINSNYSHYYVAFKNFNISISFFSIFLLKKSVQYWVNDGLMTIFFLLIGLEIKKEIITGKFNTFNQAILPIFVGIGGMIIPALIYIIFNYNTENIKGWAIPIATDIAFSISILSLYGKNISKNIFLMLSTIAIIDDIGSIIVITLFYKNNDHILINYIIYSFLSFFILIILNKIKIYKLSIYIFIGIFLWYFLLKSGIHSAITGILIGLTIPGSIKKQIKKARKYINPLYKLEKILRIPVYIFIVPMFAFLNASIKFSNINIYKCMINPIGLGIFFGLCLGKTLGIFISNYIGNYFKIITMPFDLKKQDFFSIGIISGIGFTISIFISELSFDNIEKLAIAKLSILFASIFASMLGYISLKFSKKSNII

SEQ ID NO: 120 - protein, 631 aa, Candidatus Endoecteinascidia frumentensis
MSKKSLLIEIGTEELPPKSLNSISQKFTNNFLKKLKSNNFIFKLVKIISSSRRFGFLIKKIENPLKIDLDKNKISNFIRYSLKGFSSIKMMKWGNKEYLFIRPVHWIVVLLNDKVIPICLFGISSNSYTYGHHYINNKPLKINIDQYEEKLKKSFVIPDYFERKNIILNAIKFYEKKLHSKSLISRKLLTEITNIVEWPRAILCNFDKKFLKIPEEILISVIQTHQKCIPLRNINGNFMPNFIVITNIAKSNLSCVINGNQKVMHARLQDASFSYKGDTKNSLEHYLPQLDKIIFQNQLGTLLDKVNRVSYLSQYISQKIQYNSEYAKIAGLLCKSDLMTNIVREFPQLQGIMSKYYFQGKKEIGLAISEHYFPRFSNDKIASSILGKIIAIGDKIDTFVGIFSIQNKITGSKDPFSLRRLSIGILRTIIEGKLQLNLKKIFKRSLQLYNIKKNMIVNQLIDFSFHRLNSYYKRNGISVNLVNSIISLTKKEKPLNIHYHIQDSYTFITSYRDSALILININKRIQNILKKKYIPETFTKVIPDFFSKKSEKILFKKIQEISIFLLKKKKEKDYLSIYHAFMELVIPINNFFNEVTILSQEKKIRNNRLMLLKNIKNLFLHIIDFSKLSLL

SEQ ID NO: 121 - protein, 300 aa, Candidatus Endoecteinascidia frumentensis
MKKYFSLQDIIFKLQKYWSDIGCLIMQPLDIEIGAGTFHPATFLRAIGPEPWKAVYIQPTRRPKDGRYAKSFNRMQYYYQLQVIIKPSPLNMQELYLNSLSYLGIDLTQEDIRFIEDDWESPSLGAWGLGWEIWQNGMEISQFTYFQQMGGMNCNPIPGEITYGIERIAMNIQNVNSILDIIWSNKNCITYGDILKQNEYEMSTYNFLYASIPILLEHFNFYENECNYLLNKKLSIPSYEMLLKASQIFNLLDARNAISVNERKNFILRLQYLSKIIAKSYFQERKVMGFPLCNKVENVK

SEQ ID NO: 122 - protein, 319 aa, Candidatus Endoecteinascidia frumentensis
MNEFELINYIKSKQKIKRKDVIVGILDDAAIVNPPDNKKIAISTDTLLEGVHFQKYDPPELISYKAIAVNLSDMAAIGADPAWITLSLTIPEIKTNFIKKFTRGLFNISEKFSLEIIGGDICRGPFSITIQIQGFVKPEKYLLRKGAKFKDDIYVSGSLGKAAIYFFLTNKQYKKISSSIFLSSRLKYFKPKPRINLGKKLIGIANSAIDISDGLSGDLQHILNCSNVGANIFMENIPIASDLNIFTKKEAMEIAISGGEDYELCFTAPSSKRRIIKKLSKTLNIPIIKIGEIISELKTNFLFKGYPFEFKKYSYQHFY

SEQ ID NO: 123 - protein, 470 aa, Candidatus Endoecteinascidia frumentensis
MYRPNDIIKKIKELKISFIDLRFTDTKGKEHHITIPKNIINEIFFTEGKVFDGSSILGWKNVSQSDMLLIPDLETVIEDPFSSEKTLNIRCNIFDPITKLPYKKDPRSIAQCAEDYLKSTNIADTVYFGPEPEFFIFDDIRWNVGINESYYKISSKEAIWNSGKKYKEGNMGHRPHIKGGYFPVPPIDSSHNIRSVMCKIMMKMGIEIEAHHHEVATANQNEIATKFNSLKKKADEIQVIKYIVQNVANMYGKSATFMPKPLIGDNGSGMHCHQSLFKNGKNIFSGNYYSGLSKKALYYIGGIIEHAKAINAFTNASTNSYKRLIPGFEAPVLLGYSAGNRSASIRIPYTQNAKSRRIEIRFPDASGNPYLGFSAMMMAGIDGIINKIFPGDPIEKDFYNIKNNEFHKIPRVASSLKEALIALKNDSDFLKIGNVFNNDIIDSYIKLKTDELESLEMTTHPLEFKMYYSC

SEQ ID NO: 124 - protein, 383 aa, Candidatus Endoecteinascidia frumentensis
MKLQLSNRGYVNSIAEIISTHARKLINKKNEIIYMNIGQPSTGVPQIAIKKLNDYSQNNILGYTPVTGLPILKKKISQHYKDNYGVTIDESRIIITFGASCAIILAILSLFDYNQNIVIPLPCYPAYYHTIKIHGVNPILIETQLKNNYQIQISQLDKLKKINGLIITSPGNPTGSIIDPIELKKLITYCRKNKIIFISDEIYHGISFNKNLRPETALSFSNNVIVVNSFSKYYSAPGWRCGWMVVPENLVKSISHIARNLYVSPNAPSQIIAYECFNCIKELDKNIHRYRKNREILLEEMPKAGFIDAASPDGAFYYYAKAKGIKNSLNFCIEMMNSIGVVASPGIDFDPINGKDYIRFSYAGSTRDIEIAVKRLKKWRKNI

SEQ ID NO: 125 - protein, 429 aa, Candidatus Endoecteinascidia frumentensis
MLITLVTGNMIGSGIFLLPSSLASIGSISLYSWILTSIGSILLALVFANLGNLVPKTGGLYIYTHKAFGPFIGFQTAYNYWIALWVGNAAIAIAMIGYLRVFFPILNSQLNTALSAIFIVWLLTFVNIIGVRKAGTLQVISTICKLIPILFICVLGWQYFHPVFLQKSFNITGNSNFYAVSNGAVFTLWAFIGLESATIPANSAINPKRNIPIATILGTLLTAIIYIISSTVIMGMISSGELSKSTSPFADAANIIFGPIGRDIIAIGAAISCFGALNGWTLLQGQIAMAAAENRQFPKIMAKKNKKGTPAIALCITSLFITILLLMSMSSSLIKQFNLIILMATLASLIPYFFTSMGEIILLYKNGKWNSGATKHVIIAILASIYSFWTILASGQEIIFYGMILMLTSIPLYVYVRVRYGEEKSLSFK

SEQ ID NO: 126 - protein, 171 aa, Candidatus Endoecteinascidia frumentensis
MEKKMLNDQTGKNIPNIFFKIREDNKWITINSNQIFQNKKIVLFSLPGAFTPTCSSKHLPEYEKYAEDIKNQGVDDIYCLSVNDTFVMNAWALNQKISKVKMLPDGNGDFSKAMNMLVDKKDLGFGMRSWRYSMLVINTKIYKMFIEKFEPNDPFKVSDAITMLEYLKLLK

SEQ ID NO: 127 - protein, 221 aa, Candidatus Endoecteinascidia frumentensis
MKELSKIISLPLREHLGTIIWLHGLGGKNYEFCKKISNINLSNYIKYIFPQAPMQSVSCMLGLKTSSWYNIILKKNSILESYKDILKNSDLLRNLIEEEYKLGMPYHRIFISGFSQGGAMSLYTGLTHTKKLGGIIGISTYLPVFENLNIDKSPANYRTPILMIHGKKDIIIDYKFGRKSYMRLKKWNYKAKWYDFPFGHIINNIILSKISTWMFKIIKYM

SEQ ID NO: 128 - protein, 108 aa, Candidatus Endoecteinascidia frumentensis
MKHFVLDVTSDLFNNIVLKSSIPVIVDFWAEWCPPCQILDILFKEISVEYHKKIKFCKVNIQYQEIIAKKYDIKSVPTLIFFKNFKKKAIHLGNIDRIHLKKFIDDNI

SEQ ID NO: 129 - protein, 420 aa, Candidatus Endoecteinascidia frumentensis
MNLSYLKKKSVSELIEIANSIGIDNSGRIRKQELIFSILKACIKKGKDIYGNGVLEVLADGYGFLRSSESFYIASPDDLYVSPQLIRRFQLRTGDTISGHILPPKENGERYFSLIKIISINLDFPDATKQKILFENLTPLFPQERLRMEIGNGSNEDITARVIDLASPIGKGQRALIVAPPKVGKTIILQNIAQSISFQYPECYLIVLLIGERPEEVTEMIRSVRGEVVSSTFDEPAIRQVQLSEIVIEKAKRLVEHKQDVVILLDSITRLARAYNTVIPASGKILSGGVDSNALQRPKRFFGAARNTEEGGSLTIIATALIETGSKMDDVIFEEFKGTGNMEIHLDRKLAEKRVYPAIHFNKSGTRREDLLTSSTELQRIWILRKIMSPMNEISAMEFLTEHLRESKTNNLFFKAMKRQ

SEQ ID NO: 130 - protein, 488 aa, Candidatus Endoecteinascidia frumentensis
MIIHKDLRSFIKNLAKINELKYISEEIDPFLEITEFSRRILQKSGPALFFQNPKGYKIPILTNLFGSLKRIALAMGFDNYKELRKIGELLAELKQITPPKNFRDGLSKIPLIKKIFDMKPKIIKYPVCQEVIINKKEVDLLEFPIQTCWPKDISPLITWGLVTTKNLNTNQQNIGIYRQQIVNRNQLVIRWLKHRNGAINYQIWKKKYRGKKFPIAISLGTDPIMALAAVSPIPNNLSEYAFAGLLRNKKMQIAHCLGNELDIPAHAEIILEGYLDGTLHPEGPFGDHTGYYNTVEKFPLCTIERITHRVNPIYHSTYTGRPPDEPSILGVALNEIFIPILQKQFPEIIDFYLPPEGCSYRLAIVSIKKLYPGHAKRISMGIWSYLTQLMYTKFIFITSDDINIRNWKDVIWSLTTRVDPMRDVTIIDNTPIDYLDFSSHSSDLGSKMAIDATNKLPGETKRSWGKSIHMDTKIKEKINNLLISLSIL

SEQ ID NO: 131 - protein, 461 aa, Candidatus Endoecteinascidia frumentensis
MYQMTPREIISELSYHIIGQEKAKKSVAIALRNRWRRMQLSPELRNEITPKNILMIGPTGVGKTEIARRLSKLANAPFIKVEATKFTEVGYVGRDVESIIRDLIEVSMKMTKEDAKNKVQKKAFLSAEEKILHIIILSKKKENNSKNFGFSNISPDQKMLAENPIKETEIYKEFRKKLFKGELDDIEIDIELSNPQISMEIMAPPGMEEMTQQLQNLFENINSGNRRKKTRKVPVKSAFKILQEEEIRKLINLEEIKSKAIENLEQNGIIFIDEIDKICKRENFSGGGDISREGVQRDLLPLLEGSTVSTKYGMIKTDHILFIASGAFHLSKPSDLIPELQGRLPIRVELKALSVRDFKSILTKPKASLVEQYSALLKTEGVNIKFQDDAIHRIAEIAWKVNEEIENIGARRLHTLMECLLEDISFNASDQSKKNIIINKEYVNLHLKILLKSDNLSKYIL

SEQ ID NO: 132 - protein, 178 aa, Candidatus Endoecteinascidia frumentensis
MKIIHGTTVLSVRRNNKVVMGGDGQATIGNMVAKDNIVKVRKLYHKKTLAGFAGSTADAFTLFDRFEKKLEMYQGNLERAAVELARDWRSDKILRRLEAMLLVAEKKITLMISGSGDVMGEDQFGIMSIGSGSPYAKSAARALIDNTQLEARKIVEKSLRIAADICIYTNHNLTIEEI

SEQ ID NO: 133 - protein, 331 aa, Candidatus Endoecteinascidia frumentensis
MNLLGKSFLTLKDFNFQEIEYLLNLAKKVKNEKKNNIFPLRLNRKNIVLIFEKKSTRTRCAFEIAGYDEGANITYLTNSQIEEKESIEDTAKILGRYYDGIEFRGFDHKTAELLAKYSGIPVWNGLTDLYHPTQILADFLTILEHKNTSLNKIKLTYVGDLRNNVANSLMIGAAKMGMHYVGLGPKSLFPDKKSIKSIQEYVKKSGAIIEFTENISEGVKNSNVIYTDVWASMGEEKILSDRISLLKNYQVNKDMMQKTGIHDTLFLHCLPANHDRKTKIGEMVYKNFGISEMEVSDEVFQSYNSKVFDQAENRIHTIKALMIATISREEI

SEQ ID NO: 134 - protein, 154 aa, Candidatus Endoecteinascidia frumentensis
MHNKIVISFDFGMHYIGMAVGQTITYTANPLKIVIANNGNPIWQQCDKNIQSYKPNILIIGIPIKEKNANISLKKTIIKFSQKIFLRYNIPIIGIDERFTTKESLFRIKEYQFFNRKKRLDKKNNRLDSIAACLLIETWFLSNTKFIDLNFCKT

SEQ ID NO: 135 - protein, 420 aa, Candidatus Endoecteinascidia frumentensis
LKQKYFEKFWIKDIFFSHKKIFFFVRIEMKSHDYQTFVKKIGNYNKNNMDFFLFTYNASVKKYTSKFFSLHKTNPLYKDFLQYANTISLFNLPNKIWIKKTNFNWKKIPIIITEILLSNAIQIKPLNFFQIKIFSLKEKFRNFIHLIRLNKPIPIMHMFWTTMGSLWIASKGFPGWTLFFIFLFGIFIMRSSGSILNDIVDKKFDKNIYRTHKRPITRGSISILIAWIYLILLLSIAFGLILFTNLITIIFSFIGIILLIIYPYMKRVTNWPQFFLGISYNWGIILAFSSVLNSFPPIYAWWILCSNIFWTISYDTIYAFSDIKHDKKIGLKSTAILFDKNYHLYIYLFQIIAIINWIGIGWYLSFKWYYIIPIFFCFFLFLYQHNLLQISRVKNSIKAFNNNQWIGFIIFFSIFLYYQF

SEQ ID NO: 136 - protein, 479 aa, Candidatus Endoecteinascidia frumentensis
MSILKHPKPFYIIFFTEAWERFGYYGMQSLLVIYLSHKMKMNDSQSFNTFSAFTAMIYALVSVGGYIGDHILGTKRTLILGGIILSIGYAILSMNNSSLLYISMGIICVGNSLFKANPSNLLAKCYSKNDHRIDGAFTLYYMSINLGSLISMILAPIIAEKYGWNYGFLLCSVGLLIAIINFLIFYKLMRNVGSLVDINPISYIKIIAIILASILIAFFCSYILKHLFIAHFLLFLANIVILIIFSLEIIRSNHQDKKKLLVSFILMLEAVVFFVLYQQMPTSLNFFAINNVENKIFGIEINPLIFQALNPFWIFLVSPILAWLYNFYGRKNQDFSIPIKFTIGMFLCSLSFLCLYICKFFSSSQGIVNSYWIIISYLFQSIGELLVSGLGLAMIAKLVPERLMGFSMGAWFMTTSIASIFGGFVASMTHIPKLLINKVITLKIYTHVFLEIGISTLLITIVMLFLSPVLNRMINEKNK

SEQ ID NO: 137 - protein, 105 aa, Candidatus Endoecteinascidia frumentensis
LYQIFFYVPKNFLDKVKNAVFDAGAGKYKNYSHCCWQTKGIGQFKSLKGSNPYKGKKNNIYKISEYRVELICQKNNIINIINALKKNHPYEEVAYGIIKLHKINL

SEQ ID NO: 138 - protein, 205 aa, Candidatus Endoecteinascidia frumentensis
LQKKYKKIKILNFGIIILSIKKSSVLAFNMDMINFKLLNTNPNISKKFIRLFDYTNSMPVVLAFICNHCPYVKHILSRMVFLGNLYTKKGFSFIAISSNNPIDYPEDSPIEMKKISKLLNFQFPYCFDKTQEIAKKYKVACTPDFYCFNEKHKLVYHGRFDQSIPGNKIMVTGKYLIEAMDSILNQKYPEVFQNLSIGCSIKWKY

SEQ ID NO: 139 - protein, 156 aa, Candidatus Endoecteinascidia frumentensis
MKNIKIGKIIKNFSFSATKNIKTNLWNYQGKKVLLFFYPKDNTPGCSIEIKEFSDLYEKFLTKNIILFGISSDSLEDHFKFEKKLNIPFALISDSKKEMCKYFNVIGEKKIMGKNYIGIIRSTFLIDKNSILIQEWRNVKAKKHAKLILDYINLYC

SEQ ID NO: 140 - protein, 127 aa, Candidatus Endoecteinascidia frumentensis
MVSKNNYGILVIKVVAMPSNTNMNGDIFGGWVLSHMDLGGIVAAKKYASGKFVTAGIQETAFIKPVSVGDILSIYAKHIKTGNTSITFHLTAFVNRFGTGPYEKVTEASFTYVHIGKDKKPKKIGIN

SEQ ID NO: 141 - protein, 220 aa, Candidatus Endoecteinascidia frumentensis
MKAGIVLSGCGYLDGSEIHETVLLMLALEEKKFLYQGISLKKMQWDVINHYNKKKEKENRNILIESSRIMRGNIIDIKDANIMSYDAIIFSGGFGVTKNFTNFFMKKNYTVNNEILDFSKKAFNKNIPMGFLCISAILMPFIYPRGIKLTIGNDIELANLLEKKGAKHIASYPYEAVVDKKYQAVSTSAYMTGKTLSEIKLGINELVRNLFFFYIKQKNL

SEQ ID NO: 142 - protein, 97 aa, Candidatus Endoecteinascidia frumentensis
LHKIKISGRHTSIPKELKRTLSTLLPKKSKVIMNNICSCRHNFSVGSVRIISYTLYTLKIKGYYGSGIADFFIKFYNQFDCQKIINKFKLSRKKYIY

SEQ ID NO: 143 - protein, 32 aa, Candidatus Endoecteinascidia frumentensis
MKLKNERLYKYVLINTYKISCFIRINLFLLID

SEQ ID NO: 144 - protein, 79 aa, Candidatus Endoecteinascidia frumentensis
MGLKKMMLSKRALKYIIYNSIPKNLRGRKISGHRFIIRYKNNKKIKIILNKLNIKELFSLYKSLYKNGEVNRILPTDQL

SEQ ID NO: 145 - protein, 489 aa, Candidatus Endoecteinascidia frumentensis
MKSAYSRKKINLIQNYLNYQNDDSILKKISINTLLFLSKNFPLMRSINIVCGDGNKGMHGYALAYYNNNKSIKYNIYYTKFPEKNFIFSKMKQNILKSSNNYFFKLTKKTQFCGDLIIDALIETSNIKKIQGIIKSTIININKSKLIIISLNTPSGINSNTGSILDIAVKANITLVFFALRKGLFTGSALDYTGNIILKLENKKIYKKIKPSVYILPKNAIGKQLPKRLKDSHKGSYGCVLVIGGDYGMGGAVRLSSEASLRIGAGLVIIATRKEHANFIHNSLPEAIVYGISHCYELKSLLKKATSIVLGPGLGKTIWARKIFQYILNNTSKKSIVIDADALNILSDYKKIFFHSSKKWILTPHPGEAGRLLKQPTFKIQIDRFKAVKNIQRKYNCIVILKGAGTLIQTCKKKLYICYSGNPGMSSGGMGDVLSGILGGLLAQKIPNQHASRIGVQLHSYIADIIAKKNGERGLLASDLFKLIHYYCN

SEQ ID NO: 146 - protein, 180 aa, Candidatus Endoecteinascidia frumentensis
LKNRKEKNIILVDKNDNFIGLLDKFSVHKKGLLHRAFSIFIMDNFGKILLQKRNYNKYHCGGLWSNACCGHPSFNDKNIIQAGIRRLNEEIGCSLPLFYKGSFIYYAKLNNGLIEHEFDHVLLGILNKKKVILNINPEEVSQIKWMSFYDIQKKYIKNPKIFTPWFIKVFNFVMKEKIWP

SEQ ID NO: 147 - protein, 549 aa, Candidatus Endoecteinascidia frumentensis
MSAIEVIFSDEARQKILTGINTLANAVKVTLGPKGRNVVLDASFGAPIVTKDGVSVAKKIELKDRYENMGAQMLKEVASKTSDLAGDGTTSATVLAQSIVVEGLKSVAAGMNPMDLKRGIDKATITVVSSLRALSKPCSDNKSIAQVGTISANSDESIGEIIAEAMNKVGKEGVITVEDGSGLENELDVVEGMQFDRGYLSPYFITNQEHMMADLETPYVLLFDKKVSNIRDMIGILETVAKSGKPLLFIAEDIEGEALATLVVNNMRGIVKVCAVKAPGFGDRRKAMLEDIAVLTGATVISEEVGLNLENVGLEHLGSSKRVQVSKDNTTIVDGNGDSNAITSRINVIHKQIDEASSDYDREKLQERLAKLSGGVAVIKVGAATEVEMKEKKARVEDALHATRAAVAEGVVPGGGVALVRSIKNLDKISVANEDQKHGIAILRRALESPLRQIAANSGEESSVVINKVVKNKENNYGFNAATGEFGDMIGMGILDPTKVVRSALQHATSVAALVITTEAMVAEVKDEDSSNSMPSGGMGGMPPGGGMM

SEQ ID NO: 148 - protein, 94 aa, Candidatus Endoecteinascidia frumentensis
MAIRPLYDRVLIRRAQAESTSSGGIVLPGNKEKPEIGEVIAIGTGRFRENGEINPLIVKPGDKVIFGKYSGTEIKIDGEELLMMREEDIMGIQE

SEQ ID NO: 149 - protein, 261 aa, Candidatus Endoecteinascidia frumentensis
MMIPYPNINPIIISLGKISIHWYGVMYIISFFIIWILSIFRISQKNVFFIEKQEIIDILFYAAIGILIGGRLGYILFYSWQGFLNNPFIIYKIWLGGMSFHGGLIGTIVSFGIYSYKKKCRFIYLTDFFAPMAPIGIIGGRLGNFINGELWGKVTNLPIGMIFPKAGPLPRYPSQLIEMFLEGVILFIFLWIYSKKKRPTMTISLLFLIGYGIMRFIAEFFRQPDAQLGYIAFGWMTQGQLLCIPMILIGFFLFFYVDFRN

SEQ ID NO: 150 - protein, 339 aa, Candidatus Endoecteinascidia frumentensis
MLILGIETSCDETGIALYHTKIGVLENYTYTQDYHLNYGGVVPEIASRDHIKKIIPLIKKIFKNTNFSLKDLNGIAYTAGPGLIGSLMVGASVAKGLGFILNIPTLAINHMEGHLLSPLITSKNINIIPCIALLISGGHTQIINVSKIGSYKILGNTLDDAVGESFDKIANLLGFKYPGGKELEKLAKTGNSKRFIFPIPMMKKNDLNFSYSGLKTFTIKTWEKSEKNNQNKADIAAAFQDSVAKSLLIKSKKALQNTGYKKLLVSGGVSANKKIRKYLTNLEKELKCQVIYPSFQYCGDNAAMIAYAGSIRFKKGECDSSLEINIKPRWSLEDLKNLE

SEQ ID NO: 151 - protein, 151 aa, Candidatus Endoecteinascidia frumentensis
MIKSYIGLGSNLYNSKKNIFKAWEYLSIHPKIKIIAISNLYKSSPMGPKDQPNFINAVGLIKTNLHPYALLLLFKRIEKFFGRTKNRKWGERILDIDILLYGNIKKKSSKLILPHPGCFVRDFVAIPLGDINRDLVPANFFLKKSQKIIKL

SEQ ID NO: 152 - protein, 237 aa, Candidatus Endoecteinascidia frumentensis
MKKFFIEVLNIYKIQIKFIFSLSFIFSLFKQFVSLYIQKNILKIDNHFNLLIKNSLIISLLILVIFLFSIIFTSVVQKYIFLSFYKKNKTINLKKSFIKILNLIPRIIFLSILNNIIIILGFSFYIIPGWILFFLLFLSKTFFLFRKISILQAINLSIKTTIQFNHKIMPIVMLYLLLLYFPYFFIKILLLNNGNNILFGFETVFLVFLDALIFPLLCIIQLVLYTKINILQKKYNI

SEQ ID NO: 153 - protein, 388 aa, Candidatus Endoecteinascidia frumentensis
MKLSRKIEAIKISPTLDIMQKSLLLKREGKDIIHLNSGDPKFSTPKHICKAGILAIKKGMTHYTEIDGTPEIKKAIIQKLERDNKISFDADEIIVSCGAKHSLYNVLGAILNPGDEVIIPSPYWPSYIDIVSIHNGIPIILKFSELKDFNIDSLESSITKKTKAIILNSPSNPTGKIYSKNTLKNIAEIVKKKKIFIISDDIYEHIIWKENTHLNILNIDNTLKSQTIIINGVSKCYAMTGWRLGFAAGPKKIVSAMKKLQSQNTSNPSSITQAASVSAFTGNQYFIKKMRNIFKKRHDFLVPELNKLNGFKCQPSQGTFYVFPNIKQAIVNLNLKDDIEFSNFLLKKTYISCVPGSAFGVTGFIRISYTENLKVLKKCLDRLKKILL

SEQ ID NO: 154 - protein, 606 aa, Candidatus Endoecteinascidia frumentensis
MTFNLKSKFLPKGDQLYAINSLLKGIKKSLQYQILSGVPGSGKTFTIANIIKKLGIPTVIITHNKVLSSQLYREMKGFFPSNSIQYFISYYDYYKPEAYLFKSNMYIKKKTRINQTIEQMRLSAIKSIVQRKDTIIVSTVSAIYGIGDPNIFLNIALCLKSKEKINQRKILQKLSKLRYKRSDSLILERGDYRVSGDVIDIFPADHSKMILRIELLGNIIENIFLFDPIKRKKSSSLSEIVIFPKHHFSIPKNILEKSIFNIKKELKIQINKLKFNNQILESERLEERTNFDIEMIQEFGYCLGIENYSRYFTNKNIKSRPSTIFDYFLDKNFLLVIDESHITIPQIKAMYKGELSRKKKLIKYGFRLPSSLDNRPLKFSEFENLMQKTIFVSSTPGLYEKKKNQNLVEQIIRPTGLIDPKIEVRSSITQKINILNEIKKRLKKKEKILITTLTKKKSELLTSYLKENNIKVNYIHSGIKIFDRLKILQNLYLGNIDVLVGINLLREGLDIPTVSLVAIFDADKKGFLRSYSSLIQIIGRASRNLSGKAILYANTMTDSIKEVINEIDRRRNQQISHNIKYDITPKGVKFDKRFFDNFFSLSEKDI

SEQ ID NO: 155 - protein, 158 aa, Candidatus Endoecteinascidia frumentensis
MRIFLQIARSDYNNPICQFIVKITNPILFPFQKIIPPYKGLDIASFLIILTTQIFLSTIMFLVLGVPISLYIIIESIFRLLILILNLLFFLIIIRALFSWFQSTAHNPLSLILIEITEPILLLIREKIPLIAGIDISPIVVIIIIHILIIILQNFLLY

SEQ ID NO: 156 - protein, 282 aa, Candidatus Endoecteinascidia frumentensis
MHEYKLLFIGGGNISKAIIQGLIANGYPANKIWVVDPNFEKLKYFSSELNIITEKNPKKLFKLADIILLSIKPYSIFDFIKKNSLIIKKTQALIISIIAGITCDDLHKYFGQKKTIVRCMPNIPVSINYGISSLYTKENKIDLKSQKIVENIFQKIGKIIWIKKEEDMDLITAISGSSPGYIYLIMEIIESCALDMGLEKNTAKKLIVNSMVGISQLALLSKKNFHSLRKKVSSKGGTTEAAINSLNEDSITDIIRKAIISAQNKSIYIGKNIKKKLSELKF

SEQ ID NO: 157 - protein, 286 aa, Candidatus Endoecteinascidia frumentensis
MTGFSKIYKIMNWGKLEIQIKSFNHRYLELSFNIQDFLKDIEYDLRKMIRMFIQRGKIEIIIYIHFEKMKESLEINIPLAKKILKAEKKLADNLKISTSLDACDLILLPNIIIAKKNQKNIKYILNIIPNLFKKALKELQNSRLNEGNILLNILYDKSNKICSILDKIKNRIPNFHKKYSQNILKKISEIQINNSINFEKEIINLLRKIDINEELERIKFHIKEVLTIINNKDETYSGKKLDFIMQELNREANTLASKSIDYYIIKLAIEIKMLIEQMREQIQNIE

SEQ ID NO: 158 - protein, 885 aa, Candidatus Endoecteinascidia frumentensis
MISTNQIRKIFLDFFKKKEHKILPSHSSVPNDDPSLLFVNAGMVPFKNLFLNPEKSKYNCIASIQRCIRAGGKHNDLENVGYTARHHTFFEMLGNFSFGYYFKREAIQHAWFFLTEIISLPIEKLWITVFEKDIITKKIWIDEIGINPNRLSKIGYKNNFWKMDSTGPSGPCTEIFYDHGPDVEGGPPGSINENGDRYVEIWNLVFIEYNKRDDGILEKLSKPCVDTGMGLERLSAILQRTFDNYKIDIFKFLIQKIGKICNENNLNAIELRVISDHIRSTCFLILDGIIPGNEGRNYILRRIIRRSILYGYRLNIKKPFFYKIVEPLIEIMGDAYPSLYTYQDTITNLILEEEKIFSKTLNQGIKIINYKINILKNKNKKIIDGNMAFQLYDTYGIPIDITKEIAKKNHFSIDYIGFNKCMLEQKKRSYKKNIYFNNIEKCFINFTNIRSEFVGYEKSEIKSYINIIFSKKNQQIKKLQCGEEGGIVLAKTPFYPEGGGQIGDQGEIISLCNSCKFLVKNTYKFYNIIFHVGKVISGEFNISMKVHACINTLTRKLSSINHSATHLLHSAIQKVLNSNNINQEGSFITSNKLRFDFNYSSKIEKINLLEIENMVNENIRNNHIVEIMNISLKQAKKLGAMAIFTEKYNKEKVRVLKMGEFSIELCGGTHVNRTGEIGFFKIIREYSVSFGIRRIEAITENAAIYWSQKSDNICNSIAELIGSEKKNILESIKKIIIKKNILIKKIEYLEHKNINNIQNNLLKSIKIISNISVIAEELHETLSFQLLRKLVNQIKKNMKSGIIILGSKDNIRSYLIIGITKDLTKIFKAVELGTFLSRHIDGKGGGGSEIAQFTGVKIKNLYFAIHSSISWIYKKNLKYSKKNIY

SEQ ID NO: 159 - protein, 282 aa, Candidatus Endoecteinascidia frumentensis
MFNNIKNKKIANDIQILKSQTPNIDFKKLNINSNIFSFQNFCEQINLYLEIPYIDFYRCYPNNRLILLTNSKENLQYFYKENIYPYTWVHYQKPQKYQNGYIIWALTRSEFTSHQKYLENKHKNLFGIEHGYTIITNYMKYTDFFSIYEIDKVDIYSLSIYKIQKIYHSFLRICSDDLQLIEKNSVSFPHYIWPEKWFKSAIITPFETISENEQLSTHLVSLSPREKECVKWLLEGKTAEETGIILGISRKTIESYFENIRTKLNCNNKYQIIRKVIEYNVV

SEQ ID NO: 160 - protein, 270 aa, Candidatus Endoecteinascidia frumentensis
VKTALSEDIGTGDITSNLIDKDCFSFAFIMNREPMIVSGIPILQSIFQQIDKKIQCKYFVTDSDRIKKNKKLLLLYGPTRSLLIAERTALNFLQFLSGIATTTAEYIKKISHTSCQLLDTRKTIPGLRLAQKYAVYCGGGKNHRIGLFDSFLIKENHIHASNSIISIINNARVYNPKCNLIVEVESIEQLIQVKKLNVNRIILDNFSIQDIKESVSIINNKIPLEVSGNISLNNIQNIAETGVNFISSGSITKNIKSIDLTMKLVEIKNI

SEQ ID NO: 161 - protein, 526 aa, Candidatus Endoecteinascidia frumentensis
VGYGTAGLCTALQLADDFKIAIFGKENLPEATSLYAQGGIAAVQDLSIDSINSHIKDTMLSGAELCDKSSVKFVVKNAKSLVEWLINKGVKFTLNNNQNNLWPYHLNKEGGHSHRRIIHSGDTTGKSIQITLSNLITKHPNIDIYENCIAIDLILNKSKCIGLYIYNIEKNCVQIFIGFITVLATGGASQVYLYNSNPVISSGDGMGMAYRAGCRLANMEFNQFHPTCFYQSHKTPFLITEAMRGEGATLHLPSGERFMLKFDKRAELATRDIITRAIYQEMQRLNIKYVYLDISHKSKKFVIQRFPNIYYKCLQFGYDITKDPIPVIPAAHYTCGGIMVNQNSQTDIMGLYAIGETSYTGLHGANRMASNSLIECLVYAWSGSSSIRKYLLNKDSFCTLNDKYIEYKYKKNSQKISIKKKWNKIQNLMWNFVGIIRNNQYLEKAKKELFLLKEEIDQLYELCSLNKDIIEIRNLVLIADIITKSAILRNESRGLHYSRDYPKKGNKLYISVISKNNMHFARRFYI

SEQ ID NO: 162 - protein, 332 aa, Candidatus Endoecteinascidia frumentensis
MILKNKKLLSNALIQIEKQFGKGAIIDMGKKYFEKDIETISTGSIGLDIALGIGGFPKGRIIEIYGPESSGKTTLALETISESQKLGGIAVFIDAEHALDYRYTKKLGVNIEKLLISQPDTGEEALEITDILIQSNSIDIIVIDSVAALVPKAEMEGNMGDSHIGLQARLMSQALRKLTSNLRKSKTLLIFINQIRTKIGTIFGNPEVTTGGNALKFYASIRLDIRRISSIKKGDQIIGNEIRAKVVKNKLAPPFKQVEFDIMYGEGISNYSEILNLGVKEGIIKKSGIWYTYIENNLGKGKENAKNFLKNNPDIFQKIYISLQNQYTKLKK

SEQ ID NO: 163 - protein, 147 aa, Candidatus Endoecteinascidia frumentensis
LKTFNIKKKNIKRNWIFIDASKKPLGRLSTEISFYLLGKNKPEYSPHIDCGDYVVIINAEKVFVTGNKNKKKIYYRNTGYIGNMKKFTFLDILNKNPKKIIEISVKGMLPKNSLGRSIFKKLKIYNDNIHPYGIYEKIQKKQDKLNE

SEQ ID NO: 164 - protein, 130 aa, Candidatus Endoecteinascidia frumentensis
MNKQYFIGTGKRKTSVARIFLKEGKGKIYINGIHAKKYFSRKTSLIILKKPLELFNISDKFDITISVSGGGTTGQVDAIKHGITRALITYDYNLREKLRKNGFVTRDSRIVERKKVGFHKSRKKPQFSKR

SEQ ID NO: 165 - protein, 208 aa, Candidatus Endoecteinascidia frumentensis
MTLYIKKFCLYCHCVRIVLSEKGLNANLIEINNSNNSKLLQLNPYGAIPTLVDRDLVLYETSVIMEYLEERFPHPPLMPVYPVSRGRNRLMMIRIDRDWYSLANKILHIHSSKEEKKIARECLIDSLLSITSVFSDSPFFLSEDFTLVDCSIASLLWHFPLLGIHRFKNKGKEIFDYADRIFSRTSFKNTLIESDQEIIEIFEENTIK

SEQ ID NO: 166 - protein, 126 aa, Candidatus Endoecteinascidia frumentensis
MSLYSCLIQSTYQWIINNNMTPYMLIYTKNSKNIPLRYIKKEKILLNISPVAVKNLEISNNFINFDASFSKRIYNIFFPIKSILSFYSFENKEGLYISNNGEKIFIYENKKKDNTIKKTSHLQLVE

SEQ ID NO: 167 - protein, 520 aa, Candidatus Endoecteinascidia frumentensis
MKRVISPFSLLLSSISAIIGSGWLFSSYLTSKIAGPSAIISWLIGGFLMIIIAFVFAELCAMIPITGSSIRIPQFTHGTLVSYVFSWMIWLSYLSLAPTEVQAVLQYSSFYFPSLTNIHSGQLTTHGYIVAAFLMLFISLINMYSLNWLMKFNSIFTIFKIFIPIIIIALIFSKNFSFQDIIHPENTIFMPFGWHGVVSALSSGGIVFAFNGFKQAAEMAGEAKNPKRTLPFAIIGSVFITMLIFLFLEMAFLVSLKPANLVYGWKNLVLFNNENSPIASILQQLNLHFWLFLLYIGAIIAPLAAGLMYCGSASRSLYGMSKNGYIPKIFQKVTPQGNMFYAITANFFIGMFMFAPLPGWSNMIAFLTSLIAVTYSIGPVCLLTLRDKIPNQKRPFKLPFVYLWSYISFLIATFLTYWSSWNIIKKMDIGLFIGLIILFIYKILNKTTKIDFKSSIWIWPYFIGLSFISYIGSYGGKHLFSTAWHEYFVLSIFCFIILWISRIFSLDAKSIQKYVKKNLS

SEQ ID NO: 168 - protein, 158 aa, Candidatus Endoecteinascidia frumentensis
MLYKINKILKNAKELKILAKSIAKIIRKNCLIYLKGQLGSGKTTFAKYFISALGYKGLVKSPSYNIVEYYELEEKNVYHFDFYRIRNSKDLYFIGWKDFLCNKSIIIVEWPEKGGNLMPNPNLEIIFNILYSKNTIKRSIEIIQLKKLKKNKNILSIV

SEQ ID NO: 169 - protein, 374 aa, Candidatus Endoecteinascidia frumentensis
MKKTLRISLPKWYDLHVHLRQGELLKHIILDHIQAKCYGIVAMPNTYPPITKVLGKNTKNSWSIESYIQTIKKNANNNLKTIIVPLYLSQITTPEMIQMGAKSGFLKVCKYYPPFSTTNIKKNPNLLFFMKNGVFAEMESNNIILSIHGEDNNILNTQYFDKKHNAESIFYTSIAPKIVEKYPNLKIIAEHISTKEAVNFILESGINTSATITPQHLLYTVSDLLKNFQIHLYCLPILKFKEDQDALLDAITKNDNSSFFAGSDSAPHILKFTECGCSAGCYTAPIVPQLYIQSFENFGIDMRIYENQKIFQKFLCENGPKFYGLPLAKENFQLEKKEEKIFIRKTKIGNLVPLPIAINSKKNKISTKLPWSIL

SEQ ID NO: 170 - protein, 187 aa, Candidatus Endoecteinascidia frumentensis
MNIRILNIKKSVIALKKGKVIITPTESVFGLSCDPKNINAVSKIIKIKKRLINKGMIIVAGEVNQFDNYINWNSLTKSQIQKIYQSWPGPYTWLVPPKAYISKFIIGDNKNLAVRVTSHPILAKLSLSFKGPIISTSANFSGHPPSKEYLALQPEILNQVFGILKGKLGSSLKPSQIKDAKTGIILR

SEQ ID NO: 171 - protein, 450 aa, Candidatus Endoecteinascidia frumentensis
MLSGLWSSKKYQNFIFHLSQITLFILFILTLHTFHLGKIFIFHKQYVSDNLSNFLKLYMYICISIIFLYSKSYIKNKNIIHNEFYLLTLFSLLGSMILVSANSMIILYLGIELMVFPLYGMIAMNKNINSIQSAIKYFIMGIIASSILLYGISILYGISGYFQFSQIFHFNNINLNILNFGLIFLLTGIFFKFGLVPFHMWIPNIYRDSPIVVLAIIGTISKIAIFGLISRLLFFSFFHIKWINLFFIISLLSLIVGNLLAILQKNLKVMLGYSSIAQLGFMFLGIIIGNKKGEILSLFYIVSYTFSSLGIWSILAILSQFTKEDIKYITDLNGLNANHGIISYILILLLFSMIGIPPLIGFTSKVFIINELIKIHWYYFSISILLISIITAYYYIKVIKAIYIPNINITYHKKFRISKISLIGIGVIGLGTFIIGIFPNILLSCFQYII

SEQ ID NO: 172 - protein, 505 aa, Candidatus Endoecteinascidia frumentensis
MLQENLLNFLIWLPIFTGLIIYIINKNIKIISYISLIFLILEIFICFKLLYLFDPNNYHLQFVQQYNWIPILNAKYSLGIDGISVLFIILASFLNLILILSILKRTVKECIGKDIAIFLIINGIINGIFCAEDAFLFFFFLESLLIPIYIGLINQKNIQKNKSSIKFFLFNFLGSIFLLFYILYIEQKNHSFSMIALQNILLTKKENNFLFLILLIGFGIKIPIWPFHTWYIDILKESSSKISVVLLLLMIKTGIYGFIRFSLNIIFGINQNIYIFTIILSLISTIYTALVAITENNMKKLIAYSSMSHMGLASLGIFMSCFILNQKSNLENAIICMQGAIFQMISYSISSGALFLCIGYMQDRFKSNIIKNYQGIVNIMPLLSFFVMLFSLSNIGFPGTSGFIGEFLIILSSFKINIWIALFASFVLILSPVYTLWMYKRVFFGKINNIIKAFILIKDINGIELIVLLLMLILIIYFGIFPQYIFNISYTSTLHLVNFILLHYS

SEQ ID NO: 173 - protein, 657 aa, Candidatus Endoecteinascidia frumentensis
MINNYLITIELFSIPIFPFLGSIISGVLGKFISIKNTHRFTIFLMFLSTVFSFHIFWLFIYNKYPVYNELIYNWISIGNIQFTIGLLIDQLTVLMLVIITFISLLVHIYSIGYMQKDIGYKRFFSYISGFTFSMMLLVMSNGFLLLFFGWEGVGLFSYLLIGFWFRKESANIASLKAILINRIADIGFILGISIVFMHFHTLDYQLIFHKLNSFIQSTHKIHIIGSINFNIITLICILFFIAAIGKSAQIPLHIWLEGSMEGPTPVSALIHSATMVTAGIFIIARLSPIFENSSFALSSILIIGSITSLFMGILAIVQKNIKNIIAYSTISQLGYMMIAQGISAFPIGMFHLLNHAVFKSLLFLSAGSIIHFMESEKNIQYMGNLYKNIPTTYICMLIGCLSLVSIPPFSGFFSKELIINSIENSKIYGHNFAYFCAILGTFFTSIYAFRMFFVVFHGKKKWKKKLFLKKTPLSILIPLIILSILSIFLGLFFFKPILLGNLLGNSIFIKPEYNVLKYIKISCSSINKYIFYNIFNWSFLLSIFGIFISWICYIAYPKTPYIISKYFSFIYKILIKKYYFNQFYEVYICTLIKNISQIFRIKIDLWIIHILILQGLKTMINNIGLFILKVQNFFLCYYAFSIIFGLMLFCILIFTTF

SEQ ID NO: 174 - protein, 62 aa, Candidatus Endoecteinascidia frumentensis
MLLSISTNLVALSHFKIGFLSGKILVLFILTIAAAELSIGLAIVISLFQKKKNINIKNSENI

SEQ ID NO: 175 - protein, 183 aa, Candidatus Endoecteinascidia frumentensis
MIITKNTVKSVLSLILTFISTSIIWLLLESEYLALVLILLYVGAVMVLFLFVVMMLNNDEIEKKNSRTLKEYIIAFFSGIIIFFIFFYGLNLKNNFDNYLLFSSMKNTKNINETFSLGYLLFTKYLYTFEIIGLILLVSMIIAITLTLQKNIHNKKITNQEKIKANPMNRIRIIKMKSEKNRS

SEQ ID NO: 176 - protein, 164 aa, Candidatus Endoecteinascidia frumentensis
MDYKNMYKKIFQFIKHSMFWDLIQGMYITGKYFFKPKITIAFPKENSPKSNRFRGLHALRRYSNGEERCIACKLCESVCPAHAIQITSKEYSDGSRRAEKYEIDLFKCIYCGFCEESCPVNAIVETRLHDYHFEHRGENILTKEKLLAIGEWQEEQIAKDRKKN

SEQ ID NO: 177 - protein, 342 aa, Candidatus Endoecteinascidia frumentensis
MKEIIYFFFIVKKIILFLIPLLISIAYLSFIERKIIGYMQSRIGPNRLGFFGILQPIADALKLFFKEPILPSLANKYLFLSAPLLSFIPSLAAWAVIPFSEKEVISNINAGILYLFSMTSLSIYGIIIAGWASNSKYALYGAMRAGAQVISYELAMGICLSGVMIASGSWNITKIVHMQSGGICHWYFIPLFPLFVIYWISGIAETNRAPFDVVEGESEIVGGCHVEYSGIRFAIFFLTEYANMILISALISLFFFGGWLSPFSNGFDFETKNSEIIGIIWMLLKISIFLFFYLWIRASFPRYRYDQIMRLGWKFFIPISLFWVILLSLAVRLNIHPWFSNL

SEQ ID NO: 178 - protein, 799 aa, Candidatus Endoecteinascidia frumentensis
MKKKEVKITIDKKTFIIPYNFSIIQAADSVGIYIPRFCYHKKLSIAANCRMCLIDLENSKKPVPACATLVSDGMKIYTYSKKAIEYQKSIMEFLLINHPLDCPICDQGGECDLQDIAMGYGKDISNYHYKKRVIQDIDIGPLIQTDLTRCIHCTRCIRFEKEITGSLELGMLGKGENSEIRTVLGKSINSEMSGNIIDLCPVGALTSKPFRYKARPWEIESKFSISPHDCIGSNMLLQIYKNNVLRVIPAENENINEVWISDRDRFSYEGIINKDRLLNPMIKRDNRWKSVTWNIALEHIIKSFKLIKKKYGTNVFGTLISSNSTVEEFYITQKFMRSFGSNNIDHRIQQKDFSCQNQEEKMPILNCNFYDIEFSKTIWIIGSDIRNQYPILHYRIRRAYLNGSFIAVTNPLDVNFFFKPNIHQLLNIDDIILSIAEVLKSLFQIKKKYFLLSNNMQNMLNKIQISEKARQISIQLTKEKDPILLIGSYIYNHPKYSIAIKLIHIIKKEINARGGILTEGSNTAGAWMAGAIPHRLEGGKKNIKEGIDAKKMLTKKNIKSFILINLELEKDTDFEMKTMKILKESKSVIAITQFKSRDMEKYATVLLPTCSFAENSGSYINFTGKKQYFSNAIEPYGQAKPLWKIIKKIAFLLKISGFNYNSSDEILEEYNTNIQSVEFKKEPWDEPKELPQSQIKIKRISKYIVYGSDMLVRRAKSLQETQLNKKQSQVYISRKTSKILDLKDGDFIFAKKKHGSYIKLQIYIDSSLPDKNIIIPRTIKEYNILGENFNEIILKKDLK

SEQ ID NO: 179 - protein, 412 aa, Candidatus Endoecteinascidia frumentensis
VCFRTKYLKEPWSIKTYKSIGGYSAWIKILTEKVSPKKIIEIIKESELRGRGGAGFPTGIKWSFFPYDIPGEKYVICNSDEGEPGTCKDRDIMKYNPHQILEGILIACYTMGANIAYNYIRGEFWLPFSRMETAIKEARKEMLLGDNIQNKKININIYNHLGAGSYICGEETALLNSLEGKKGFPRLKPPFPAVYGLYGKPTNVNNTETYASIPPIIQYGPKWFSSIGRPNNGGSKIFSVTGDVERPGNFEIPLGTKFSKLLDLAGGVRKKNKIKAVIPGGSSSKILTGEEMMNCHMDYDSLGKAGSMLGSGAVIVLDETRNIVKILCRFLKFYTYESCGQCTPCREGSGWILKKIQKILKGKGNMSDIDYLFKIAKNIEGKTICVFGEAFSWPVQSYILKFRNEFQQLIKN

SEQ ID NO: 180 - protein, 170 aa, Candidatus Endoecteinascidia frumentensis
MSKIISQLSEKIKKEINIWISKYPNGRKQSAVLQALMIVQENEEYRYLKKESIIAVAKYLNMPEIAVMEIAYFYSMYELFPCGKNKISVCTNVPCQLKNSDFIVKYLKKKLNINFGETTKDNLFSLREVECLGSCIDAPVLLLNKKYYGNLTYKKIDSIIENTKKNFYEN

SEQ ID NO: 181 - protein, 415 aa, Candidatus Endoecteinascidia frumentensis
MSIEYKNYTMNFGPQHPSAHGVLRLILDLDGEFVKHADPHIGLLHRGTEKLAETKPFNQNIGYMDRLDYVSMMCNEHAYVMAIEKLLNIKVPIRAQYIRVMFAEITRILNHLIWLGSNALDLGAMSIFLYAFREREDLMDCYEAVSGARMHATYFRPGGVYRDLPEEMPKYNNNFSIKKNKRNKNRQGDLLDFIINFTERFPKCVNEYESLLTNNRIWKQRTIGIGKVSADHAISLGFTGPMLRASGIEWDLRKKQPYEIYNKLKFDIPIGEKGDCYDRYLVRVEEMRQSNKIIQQCAFWLKKNLGPIIEKNYKVVPPDSKNMKTDMESMIHHFKLFSEGYCVPEGKIYVGTEHPKGEFGITLISDGANKPYRLKIRAPSFTHLSAINKMLQGHMLSDVPAIIATLDIVFGDVDR

SEQ ID NO: 182 - protein, 217 aa, Candidatus Endoecteinascidia frumentensis
MNELFNLLQKIKEFSGKKSLIKGKIIQGQIWIEIFPSDIRLISKYLKNIDFTHLIDIVGIDYLHYGYSYTNLGEKNPFKNFKQKTKNVFNKRFGIIYHLLSTKKNIRLSFECLLDEKNPYIESVIEIWENANWHEREIFDMFGIIFKNHPDLRRILTDYGFIGYPFRKDFPISGNVEIRYDKLLGRIVYEPVNIKTPNNSPKVIRNDNRYYQYNAKD

SEQ ID NO: 183 - protein, 154 aa, Candidatus Endoecteinascidia frumentensis
MIGGKGFITTNMNKLIRWARSGSIWPLTFGLACCAIEMMHAGGSRYDLDQFGVMFRPSPRQSDLMIVAGTLCNKMAPALRKVYDQMPSPKWVISMGSCANGGGYYHYSYSVVRGCDRIVPVDIYVPGCPPTAEALLYGILQLKNKIKKDNIIYR

SEQ ID NO: 184 - protein, 105 aa, Candidatus Endoecteinascidia frumentensis
LVIGNKFFFFVEKSKYPNTSDLKEKSSAFECGFEPFSSARIQFNIRFYLFAILFIIFDVEVAFFFPWALVLKKLPFSGFIGMIIFLLFLFIGFVYEWRKGALEWE

SEQ ID NO: 185 - protein, 31 aa, Candidatus Endoecteinascidia frumentensis
LLFSTKKKNLFPITNIIPNIKRIKKNMKMEK

SEQ ID NO: 186 - protein, 101 aa, Candidatus Endoecteinascidia frumentensis
MLHIVLFFHILICIIVVGLVLFQKGVNTNIGISFDNSISKDFFGSKGPEFFLKKITGFCFLIFLLTSLFLSYLANNKIHYDQELHIKYFNNSKNIATSKKI

SEQ ID NO: 187 - protein, 588 aa, Candidatus Endoecteinascidia frumentensis
MLKIRNTIFILIKNSLIALKKSKKFLIYESYFDEIFINIPLKKEYGDFSTNIALRLSKKIGISSNNLAHIICNNIDKNNLINFIKVIKPGFINFYIHKNNHFKIIKNLVEKKTWRHKKNIKEKWHIEFVSANPTGPLHVGHGRSAAYGSALANILCEYGKSVYTEYYINDSGRQIDILTISVWLRYIELHGIKFDFPKNIYQGFYIKEIAKKINEKIKNIPIFSQKEIFNNLNKQDMIDNQELYIDKLIFNIKYLLKFDIYKYIYEYSLKWILKDIKNDLSEFSVTYNLWFSEKNLIKKNEIQKAIELLKKKKYIYKKEGATWFHSKKFGDDKDRVLIRENGQTTYFASDAAYILNKISRGFNRLILILGADHHGYMLRIQALMQAFGLNNQNLKIPIVQFVRIVKNDKLTQMSTRSGFFITFRQFRKKIGNDIARFFYLTHKVDQHIDFDINFIKSQNNENSLYYIQYAYARICSVFKMQKNKKLKFNSINGLKSLHLLKGSYENCLINLLNKYPYVLEKSAHTLQPHLFILYLKDIAKAVHSYYNSQKILVEDIFMRNARLCLLFSIKIILKKSLYLLGISSPKKM

SEQ ID NO: 188 - protein, 68 aa, Candidatus Endoecteinascidia frumentensis
MADGTIKWFNRTKGYGFIQPKEGGNDIFLHISSLERSGIKKINDGQKVTYEISEKNGKKSAINLTLID

SEQ ID NO: 189 - protein, 318 aa, Candidatus Endoecteinascidia frumentensis
MNQFYNPNKKNRNFDKLSRIPIKIQPIQNSHRKRIPKWLYTKLPNLSKSLKISYIKNILRQNNLYSVCEEASCPNLSDCFEKGIATFMIMGDRCTRRCTFCDVAHGKPFPLDPEEPKNLSKAVQIMNLKHVVITSVDRDDLRDGGAYHFSECIKSIRKLNKTIKIEILTPDFRGKNRINIALNILHKNPPDIFNHNLETVFSLYPKIRPGSDYFWSLNLLKEYKKQNPTILTKSGIMLGIGETDQEIEKVLLDLWKHNVDIITLGQYLQPSNFHTKVDRYISPNKFKYFKYIAKKIGFKYISSGPKVRSSYYAEEQIK

SEQ ID NO: 190 - protein, 216 aa, Candidatus Endoecteinascidia frumentensis
MKIDVCYYKGCTPYQKIYQKMKLFTKIRNKFTKDSIWITEHFPVYTLGRRRNTNNILKPSTIPIIFTDRGGEITYHGPGQLIIYCLIDIKRLKLGIKNFIFFLEESIIKTLKSINIYGERKINQPGIYIKEKKIAFLGLRIKNGKSYHGISINTKMNLYPFQNINPCGFKNLQVTQVSEYYDIPLINLGKIFLQKIITQLYNNNCHYNLYCNESIL

SEQ ID NO: 191 - protein, 91 aa, Candidatus Endoecteinascidia frumentensis
MHDINVIKSKFSFPCIFPIKIIGISNRKVEKFILQILKNNLYKKNNLQINTQNIQKNNYISVTVLFTANNEDELIKVYQKLKENSDIKIII

SEQ ID NO: 192 - protein, 214 aa, Candidatus Endoecteinascidia frumentensis
MKQKKLLQFLIKILDAFKADHIQILNIKNFFMTDYIIISEGTSSKHIYAIGENIKYKIKYFNYQGLCIEGFTKNTDWILIHIEYITIHIMLKKAREYYNLSNIKGLDITNSFFKKKKMDKNLLHNNLIQKIYELKKIINKEKIYNCILFKKIEKDKEKLFYFIEKNEFKINSIKSNSEEKIFLYQKKRLKIHIEFISKLQILREKIKKLPIKVF

SEQ ID NO: 193 - protein, 311 aa, Candidatus Endoecteinascidia frumentensis
MKKYFFQKILNFKGTKFLSESFEKLFNSNISNIQNILESLEEILLKADVGFTTTNFVLNILRSKIKIKNIKNKKIIKEILKEELLKILSETHCQLSKFYVPSHNMLYCILILGVNGVGKTTIIAKIAKYYKDLNLKVALAAGDTFRAASIEQIQFWGKYHKIPVIAQSIGSDSASVIFDAIQFSYAKNIDVIIADTAGRLHNRKNLMHETQKITKVISKFNSKKLINENMLILDAGIGQNSFRQVEEFKNFIKIDSLSLTKLDGTAKGGIIFSITKELKIPIRFISFGENINDFQEFKEKKFVDNLFKKTI

SEQ ID NO: 194 - protein, 293 aa, Candidatus Endoecteinascidia frumentensis
MWKFQTIGLVGSYKSILVIKTLNYIYQLLTNWGITIILENKTAFLLKKKNGISIKKLTKNCDLIISVGGDGNLLSVARISSLYNVPVIGINQGKLGFLTDINPSDVHHELKEILKGKYIECKRFLIQGIIKKNNKKAIFFGNALNDIVLYSGESSHLIEFEVKINNKFVYTQRSDGIIIATPTGSTAYALSAGGPIIEPTMDALVLVPKFPHTLSNRPLLINASSKITLIIGYYKKSNPKISFDGQNNCEIKTGNIIHINKQHETLRLLHPKNYNYYQSLRNKLYWSQQLLNI

SEQ ID NO: 195 - protein, 326 aa, Candidatus Endoecteinascidia frumentensis
MSNIVIIGSGSWGTALAIVLSRNKNTVFLWSKRKEHRKAMQFDRENKEYLPGIKFPNNIFILNKPTIYFAEYIILAVPSFAFHLSLKFFSKNWKKHQKLIWVTKGFFKNGYFFSNIVNKILGKKIFKAILAGPSFATEVAKGLPTIVTAAGDTKHFSLQIKNLFQSKNFKVNISKDFIGIQFSSAMKNILAIIIGIIDGIGGYGMNAKSSIITYGLAEISKLGCALGVKQDTIYGISGLGDLILTCLDNQSRNRRFGILLGKGYSIKNAFKNIGGLVEGFYVVKITYNLSIKNRIYMPIIHEIYQILYQKGSAKKSIKYILKIIGK

SEQ ID NO: 196 - protein, 147 aa, Candidatus Endoecteinascidia frumentensis
MNQKIENNKSYNFYIHKIFIKDLSFEVPLGKEIFTKEWKPKLNLKINHNNKHLKKKFYEVNLQFQCNVQNSEFIAFKIDIKQAGIFEINCIEDKKNYIVNSFCPNLLYFYLRESISDLVAKGGFPQLILHPINFDLLYQKGEKNFAI

SEQ ID NO: 197 - protein, 84 aa, Candidatus Endoecteinascidia frumentensis
MLKVEIYYADWCPYCKKALDIFKKKNIKYILYNIDKSNKIKEESIKRSGKTSIPQIFIGNKYIGGFDELNKLNKQNKLNYIFNI

SEQ ID NO: 198 - protein, 245 aa, Candidatus Endoecteinascidia frumentensis
MDIENFSIFVRNNIYLFLIVFLLMFFLIIFQIKYIKNAKFYLSIIDSIILMNKNSSILIDIRKKEKFNKEHISGAINLEYIQNLNKDYSKIDILKNNKKKDILLVCDFGKLSNEFAIILNKLGYKKIFIIDGGIKKWKEENYPLINNITIKKGKMLNSISNKKNLVEEVRKRLSSLNPIYLKIIDCTDIHIKHAEFNFEKKYFKIIIKSKIFVGMPKISNHRLIYKTIKDLIPKYIHSFSIKIKK

SEQ ID NO: 199 - protein, 246 aa, Candidatus Endoecteinascidia frumentensis
LKKKERLQKILANQGLDSRRKIEKLISSKKIKINGKIAKLGEKITKKKDKIFVNGKQFFIKDNKNLTKFIIFHKSEGQICSTNDFKKKKSVFHFLPKIPFGKWIMIGRLDINTSGLLLFTNNGDIAHKLMHPFYKIEREYLVRVMGKIDDIFFKHFIKGVQLKDGVAKFSKIIDMNKGKNCNHWYKIITITGKNRQIRRMLKFKNLLVNRLIRIRYGCIKLPKKLSKGTWKFLESKKIQDIYKMIK

SEQ ID NO: 200 - protein, 372 aa, Candidatus Endoecteinascidia frumentensis
MKKLILNDIYWMKLAIKIAKYGMFTTKPNPAVGCVIVKNNTLLGKGWHTQYGKDHAEIMAINSVKNKDQLRGATAYITLEPCNHFGKTAPCSEALLNFGISRVVIGAKDPHETKNESGISKLIKSGIEVIIGVCKPESENINIGYNYSYNYHKPYVRCKLAMSLDGKTSMISGKSKWISNISSRKDVQYLRARSGAIITGINTIIFDNPTLGIREEKLLKKYDRKILQPIYVILDRKGRLPHNAKIIKYNKKYNTILWHVVEKETINTKKLGIQTIQYKKEDNLSWILNQLYQNNIHDVLIESGPTLSGQAISQGLINELWIYIAPKLMGNWTNPLLILPEIKNMDDIIHLKLIHAKKIKEDLRLIYKIKKK

SEQ ID NO: 201 - protein, 195 aa, Candidatus Endoecteinascidia frumentensis
MFTGIISYIGNISQKKKLKNQLIISVKNWDFYPYIKIGNSMSINGVCLTVIEKKNNNLTFDLSQETISSTTLWNLDINALVNIERSVGINNPFEGHYVTGHIDSIASIIDITKKKYSFSVSICVNKNIDKYIVKKCSVAVDGVSLTVNQIKNRIFEISIIPYTWHHTIFYSYKIGNTVNIEIDIIARYIEKLIQF

SEQ ID NO: 202 - protein, 346 aa, Candidatus Endoecteinascidia frumentensis
MSNKHQYEFAIIIGRFQPLHKGHVYLIKSALLHAKKILILLGSSYRARSVRNPFLFTERKNIIIQEINKNIFKYKNKIIIDFIEDIMYSNKIWINMVINKVKKYVKIDKNIILVGYKKDKTSKYLSFFKRWYFCSIKNYQSINASGIRKCYFIYKMIQEKYLPESSIDFLKKFFFTNNYKKLRKEALFIQNYKNKWIFSPYPIIFFTIDTLLTINNNLLLIKRKTYPGKNLWALPGGFLKENEPIHIGLLRELKEETSINLDNKTLLKNIQKKHIFDHPNRSQLGRIISFAFWINLKNKNLPYIHENSDAKKVLWIPLKKIYLFKNKMHDDHYYIIQKFNIFKFLN

SEQ ID NO: 203 - protein, 160 aa, Candidatus Endoecteinascidia frumentensis
MKLILGIDPGLNITGFGIINYQNLQFQYIASGYIKTSYKNTESEKLFIIYTNIYHIIEKYHPKQCAIEEIFVSKKNFNSSLKLGKTSGVIQAAISAHKLSIFTYSPKKIKKLVTGYGSASKKQIKKMVSKILDIYKVEKQDTSDALAIAICHALSQSNYK

SEQ ID NO: 204 - protein, 204 aa, Candidatus Endoecteinascidia frumentensis
MIAILDGIILKKKPPYIILDVHGIGYEIETLMCYFEYFPKIQNRISIYIYHVIKKDIPKLFGFTNLDDKYLFKELLKINGVGYKNALSILSNMKNSKNFIQSLINNDINSFIKIPGVGKKIAKRIFIETKNNLKNWNKYKENKKNIISKNLIDSNIFLKKKDAISALISLGYKETLVKKIIKKLEKKIYNLTTSEVIKIFLKNI

SEQ ID NO: 205 - protein, 338 aa, Candidatus Endoecteinascidia frumentensis
MNLFKSKIDIKKNMKMNISLLKEYRAKIKDLLKKKNAVLISHYYVDSEIQKIAEETGGIVSDSLEMAKFGISHPAKTLVIAGVHFMGETAKILNPKKNVIMPTLKATCSLDIGCPLEKFIKFRNQHPDRIAVVYANTSAMIKAHSDWVVTSSCALDIIRYLDRKKKKILWAPDKFLGRWIQKQTNADIVLWNGSCIVHEEFKSQGIKKLKYQYPNSAILVHPESPEDVIAIADVVGSTSVLLKATQSLSNNVFIVATDKGIFYKMQSLSPKKVFIEAPTGGHGATCKSCAHCPWMGMNNLKNLAETLEYGYNSIHIENSIQKKALISLNRMIQFSKNL

SEQ ID NO: 206 - protein, 409 aa, Candidatus Endoecteinascidia frumentensis
MKNCKKLRQKSLNYHEKPIPGKLGTKILKPIETKYNLSLAYTPGVAEPVRKIAENSMNAYRYTNKGNLVAVISNGSAILGLGNLGAIASKPVMEGKGVLFKLLADIDVYDIEIDSKSIASFIQTVYEISPTFGGINLEDIKAPDCFQIEYELKKILDIPVFHDDQHGTAIVIAAALLNALELIDKFLNKIKIVCLGAGAAGLATMNLLVKMGVDKNQITVLDSKGVIHSSRRRLNIYKYAFAKHTNLRTLDDAIKKADVFIGVSGPNLLKPEHLKSMSENPIVFALSNPDPEINPELAKSVRKDIILATGRSDYPNQVNNVLCFPYIFRGALDAKIKKITYSMCFAAIESIRNIAKLPIPKTMIHLYPDINNINFGREYLLPNPMDPRLKKKVSTAVFQAALASNIIRK

SEQ ID NO: 207 - protein, 324 aa, Candidatus Endoecteinascidia frumentensis
MSKKKIAIIGSGNIGGTIAQLILFKKLGNIILFDIIQGKSQGKALDLLQCSPIEEFNNTIIGSNDYSDIQGSDIVVVTAGITRKPGMNRNDLLLYNGNIIKNIGEKIRKYAPNAFVICITNPLDTMVSLLQHFSQISDKKIVGMAGILDTARFRTFLSLEFHISITQIHAYVLGGHGDTMVPLISSTNIAGQSLNNLIKKGIISRKKIDNIITRTKKGGGEIINFLKKGSAFYAPSSATVQIIESYLEDKKYILPCSAKIRKGEYGIKNKLFFGVPICIGSKGIEQIIEIPLNKQEKIDLQRSVDIIRKNNVESDKIFIKSLSN

SEQ ID NO: 208 - protein, 218 aa, Candidatus Endoecteinascidia frumentensis
MLKLIAKNSIIFFCFLTINIYGNNLISLSRKNIFLKSKNFNQGPYIGVNIGHVIPSIDIDTRNWMVYKSLDFGIFSGYKFNKYINIEFNADRISVLENYIKTRTSIIPFSKIEIYIFHIHGIIMFPIIIKYQYIFSLYGKIGYGGSYNYGYYIKYNKPFSINNSYISYDIGFGININWISNINSRLEYSYYQNNFSITSKNNIKYPKSIISINFYYNL

SEQ ID NO: 209 - protein, 355 aa, Candidatus Endoecteinascidia frumentensis
MSKIIIGMSGGVDSAVSAYLLLKKGYKVKAVFMKNWEEDDEEFCSVHRDLKDAEIVCEHLGIELKKINLSNEYWEYVFKVFLSEYKNGNTPNPDILCNSEIKFKIFLQYALSLGADKIAMGHYVRIIKNKNNYIELIKGFDKKKDQSYFLYALSQKQLNSSIFPVGNMTKKEVRNIAIKLGFINAKKKDSTGICFIGHNKFKKFLERFFTKNFGDIITTSGEKIGEHEGLMFYTIGQRKGLKIGGNKNFSEDAWYVSKKDIKKNQLIVVQGEKNHLLYKKKLKANNINWISGHPPSSKFFCNAKIRYQQNDKRCIVLVKKKNIEVIFHEPQRAITSGQSVVLYLKEKCLGGGIIM

SEQ ID NO: 210 - protein, 420 aa, Candidatus Endoecteinascidia frumentensis
MNYKNIKIPQGYKIIQSQKEKIVVPDNPIIPFIIEDNTNIIHLIVKQLVNIAVKKAYDNNRKISWMDIYLGKESEKNYGKNIYLPDESIKAIEEFGIAIRGPSKYIYSSEKSIYSINFSLEKILNLYICCQKIYYFFGVPSTIISPQNINMTIFQENSEDIYTGIEFQSNSLKAEKMINFLRKEIDIRKISFTEHCGIGLKISSRPAVKRIMNYAIQYAINNDKKSITLVHKGDIMKFTESDFRKWGYEFAKNKFNAKFKKIKNYFEIKNPKTGKNIILQDILIDDFLQYMQISPEKYDIIVASYLNGFYISKILSSQIGFGTLSSKIFLGRNIVIFDNSSSYKILLKKNIDIKDNPIPIILSSIEMLQYIGWNTSADFLMKGLSKFLSNSEISYQISGIKKNLIPLNSNEIAKHIIQNI

SEQ ID NO: 211 - protein, 72 aa, Candidatus Endoecteinascidia frumentensis
MAKEENIQVEGTVIESLPNTIFKVQLENNHVIIAHISGKMRKNYIRILKGDKVTVEISPYDLTKGRIIFRNK

SEQ ID NO: 212 - protein, 212 aa, Candidatus Endoecteinascidia frumentensis
MNKKKIFSILEKLKKEYPKPNTGLKYNSTFELLISIILSAQSNDIQVNKITKKLYSIAYSPEKIISLGINKLQKYIKTVGLYRNKANFIMQTCHILVNKYRSTVPSSEEDLLSLPGVGRKTANLILNIIFEQPTIAVDRHVLRVSNRIGFVKEKNPEIVEKILLSLVPYSFKKDFHHLIVLHGKNICKSKKPKCVNCSIGKLCKYPKKYFKN

SEQ ID NO: 213 - protein, 206 aa, Candidatus Endoecteinascidia frumentensis
MLLIDLIDSKLPQTQCKRCNYKDCKSYAKALVDKKAEINKCKTGGQKVMQSLAKLLNKKISSFNQTDEEYSIATIKEDLCIGCMKCIEVCPVDAIIGTKKMMHSVISQECTGCKLCLKSCPMDCIYMTPSSYFRDKCQSNHYQEIQRKIFKNRYKEKKLRKAKKIYLQNKKYKKYNVLENTKIKQNERKKFIKNACQRYKEKINSL

SEQ ID NO: 214 - protein, 267 aa, Candidatus Endoecteinascidia frumentensis
VHEIEKIEKNISELEFSSMFRITDNYNAYLDIQSGSGGIDAQDWARILLRLYFKWGISHNFFPKIIESTSGDIAGIKSATIYFSGNYAYGWLKTETGIHRLVRKSPFNSLNRRHTSFASIFVSPDISQNKKLYVNINLSDLRIDTYRSKGAGGQHVNRTDSAVRITHLPTNTVVQCQNNRSQHQNKSQALKQLQSKLYAILLQKKSKEKENIEKSKLDICWGNQIRSYILDQSRVKDLKTGIETKDVQSVLNGNIDQFIKASLKEKL

SEQ ID NO: 215 - protein, 371 aa, Candidatus Endoecteinascidia frumentensis
VFIYIFFILVILFFFIAIIFFKFQERETYLALEKKILLQLSTFHIENIKNFHKELQEGIREQEKNLQHTVQENYKILADQLNRISQNTNNNLKNISLTVEDSLYKGFKKNQNTFINILERTAVLDESQKKLIELSQNIISLKEILSDKRSRGAFGEMQLSMLIKNVLPENVFKLQYTLSNKKRVDCMLFLPKPTGNIAVDSKFPLESYQKISNHNLPEIEKKKFKKQFQRDVKKHILDISEKYIVPGETADSAIMFIPSESIFSEIYSYYPGLIEISHRKKVWISSPTTMMAILTTICSVLKDHSTRKQVHIIQDHLHFLAKDFIRFQNRMDNLQSHIQLINKDIESIYISAKKISSRFEKIDKTEFSHAK

SEQ ID NO: 216 - protein, 1612 aa, Candidatus Endoecteinascidia frumentensis
MYVQAYVSNSRKLIFDKLEILLKKKLNFLEAKYLSIFMKKYYASASEEDLNSRSISDLYGGLISQWNLLQKRKTKEANIKIYNPSFEESGWNSNRTIIEISYDDMPFIVDSILLYLNSIEVNIYVVFHVGGLLIYRNKVGNLLSLYQEQNISKNSFLFTETAISIEISKQNNPIILNKIKNNISNTLNNVDIIVSDFEKMKFFLEKTIKNLKYNYYNFPKKEILESVDFLKWLYNHFIFIGSGKFIRYKKQNKLSFQLVSSSNLGLLKKESFLNENIKEIEMLENISYDLLNPISIIKSNQISTIHRSSHFDIISVKNFSIKGEILGETRFIGLYTSMVYHNSCRYIPFLRRKVESVLFKSGFSQNGHDAKALINVLEKFPKDELFQINETELYQISIEILQIQERKKIKLFVRNDSYNRYYYCIIYFPKEKYNTNIRKKIQNILLNSFKGISSNYIPIFLESVLCRIDFIIKVDPNISNNIIYNIKDIELKIIEATYSWKDKFKKNLLKNRKKIKSLKLYKKYKDAFPLGYREFFSIEVIIDDIFKIENFLDKQKICFSFYQTLSDDNVNLIRFKMFHKNEILPLTKVLPVFGNMGLNIVDERTYKILPYNKKIWISDFGIKNDYSLSLIKERLIEFQDAFFNIWIGNAENDKLNFLVIQKRIKWRDIVIFRAYTKYLIQIGCSYSQKYIENAIIDHANIAKKLIKLFYIKFSPNFFNEFSFQEIKNYEKKICNLISQVSIIEYDKILRKFLNLFKSTVRTNFFQLDKNKNFKSYLSIKFDCTKIENFPEKRVIYAIFVYSPHIEAIHLRSAKISRGGLRWSDRHEDFHTEILGLMKAQHIKNSVIVPLGAKGGFICKKIKKASHKDFLLEGIYCYKIFISGLLDLTDNIIDGKIITPPNLKCFDDSDYYLVVAADKGTTTFSDIANNLAKKYNFWLGDAFASGGTYGYDHKKLGITAKGVWKSIERRFLEIGYDINSRDFTVVGIGDMSGDVFGNGMLLSNRIQLVAAFNHLHIFIDPNPDPLSSYKERERIFKLPRSSWKDYNANFISEGGGIFNRSDKLIPISMQMKKRFYITEKMLEPNKLIQFILKAKIDLIWNGGIGTYIKASYENNNDVEDRANDAIRISANQLRCLVIAEGGNLGLTQKGRIEYALKGGGIYIDAIDNSAGVDCSDHEVNIKIILKKAVEIGRISFIERNNLLEKMQDEVVQLVLSNNYAQTQIISRMSIDGKKEIGSFIRLIQKLEEKFYFNRITESLPSKKEMKIRKSTGKGLTTPEISVLLAYTKIMIKQELLKSKIYKDPYCKKFLKAEFPVILSEKFEDLMSKHILASEIIITTLTNFIIQRMGITFFNRMYDETGANSEEIAKSFIVVNELIQVDNIWFQIEKLEKNISYKAQKYMILEITKIKRKLCRWFLKNHKLKCSIQSSINSYKEKLNKIKIMIPNMLGKYDLETQNRYIQECKTQGIPTSLSLEIKNISYISYCLDIIETEKNFNIVLFELLEIFFLLNEIMSFSWIRNTLLKKKYNQEYWKTLAISSMRDDLDHLQCVIAKNISLLNKYNTSKKKIDKWIQINFSLVKRWNEMIELLKTNNSQNMVLLIMTFRSLLDLTN

SEQ ID NO: 217 - protein, 521 aa, Candidatus Endoecteinascidia frumentensis
MNIYKKNIFTSNKILILDFGSQYSQLIARKIREIGVYCEIMSYDSPKEKIQDFSPKGIILSGGPKSVYQKNRYSIPNIVFDLHCPILGICYGMQILTLQLNGKVEKANIREFGNTIVQIYKKSPILKNIPKDFFQVWMSHTDNVIKIPKDFQKIASTKNSPYTIIENRKKNFYGIQFHPEVSHTEYGSSILKNFLNISNCTRTWKKKNIVENLIKGVHKKIKKNKVILGLSGGIDSLVTALIIKKAIEKKLICIFVNNGLLRIKQEEEIKKINKTLKLNIIYINAKKKFLEKLDGVSDPEKKRKIIGKLFIEIFQKEADKKNIKWLAQGTIYPDIIESAKKNHISNKAEVIKSHHNVGGLPKNMKLYLLEPLKNLFKDEVYAIAKLLGLSDNFIYQHPFPGPGLAIRIAGKFKIKYLKILKKADYIFIKILKKKELYQKINQAFAVFLPVKSVGIIGDKRQYEYIIVLRAIKTIDFMTANISQIPYEILEEISQAIINQISNISRVLYDITNKPPATIEWE

SEQ ID NO: 218 - protein, 486 aa, Candidatus Endoecteinascidia frumentensis
MIQIIEEGLTFDDVLLLPKYSKILPKNVSTKTFFTKKIRLNIPLISAGMDTVTESKLAIAMAQEGGIGIIHKNLSINEQVLEVKKVKKFKSGIVKNPITVNPENTVRDLIKITKKYHFSGLPVVKNANLIGIITNRDIRFVKNLEKKISSLMTPKEKLVTVQEGEKLAQVKYLLHKHRIEKILVLDRKKKLQGIITVRDIQHAEEKPFSSKDKDGRLMVGAAIGIDDSSKNRVQSLISEGIDAIVIDTAHAHSERVINYISWIKNNYPNIQLIAGNIATASAAVALAKSGVDAIKVGIGPGSICTTRVISGVGVPQITAISNVSDALSSYNIPIIADGGIRYSGDIIKAIAAGGYSVMIGNLFAGTKESPGKMELFQGRSYKSYRGMGSLSAMKKGSSDRYFQEDNYTEKLVPEGIEGRIPYKGSVKKVIYQLIGGLKSGMGYTGSSNINVLRTQSHFIRITNSGIRESHVHDVNITKESPNYQRY

SEQ ID NO: 219 - protein, 285 aa, Candidatus Endoecteinascidia frumentensis
MVAKIIDGKLISNEIKKNIKYEIQNRLHIGILPPGLAVIIVGTDPASLIYIENKKIACREVGINSYQFSFPYHVKEKTLLTLIEKLNLDNKIDGILVQLPLPSHINEHKIIENIFSKKDVDGFHPYNLGLLAQRRPYLRPCTSKGIITLLKKTLKNDISGFHAVVIGASNLVGRPMSLEFLLEKCTSTVCHKFSHNIKNIAKKADILVSAVGIPRIITADWIKPDAIVIDVGINRLANGKLIGDVDYYPVSRKASWITPVPGGVGPITVATLLENTLFASKKLKK

SEQ ID NO: 220 - protein, 325 aa, Candidatus Endoecteinascidia frumentensis
MNILIIYSGGTIGMKKKNNKLVPDSRYLKKYIQKNIELKEKNIPYFRILQINPLIDSSNINICHWNNFIKIIKKNKIYYDGFIIIHGTDTLSFSASALSYVFYYFKKPIILTGSQFPISKTYKDGHKNLLESLKIIMKIKKGCYIYFHKKLLQGNRSTKYSNISNDAFFVPNPIFQKGLKPFRDIVFSKFKKFKNVNIIVITFFPNIDLRWIRYIFCIKPQVIILRTFGSGNVPNNIPILYSLLKKCAAYGCLIINISQCQHGYVNSKKYAVSDKINNITNIISAGDMTFEAVITKIFYLFSLQINKDKIIKLFKKNLCGERSYY

SEQ ID NO: 221 - protein, 263 aa, Candidatus Endoecteinascidia frumentensis
MFIKIKSLEEIKKMKISGKLAASVLSMIKPYVKPGVTTNYLDKICHNFITNTIHAIPAPLNYKGFPKSICISINHVVCHGIPSKRIIKNSDILNIDITIIKNGYHADTSKMFFFDKSPILGKKLSKITYKAMWEGIKKVKPGARLGDIGSAIQKYAEYHKFSIVRDFCGHGIGRDFHEDPQILHYGVEGTGEILKEGMTFTIEPMINAGKYFTTTLPDGWTVVTKDRSLSAQYEHTILVTENGYEVLTLREEEKHNKYNNIIF

SEQ ID NO: 222 - protein, 263 aa, Candidatus Endoecteinascidia frumentensis
MSKLSMRDMIKAGVHFGHLSRYWNPKMKPYIFTKKQKVHIINLEKTIPMLSKAMDYIADIVLKQGIILFVGTKRAAKQILKEEAIRAGMPYINHRWLGGMLTNYKTIRKSIRHLKELDQMEIDGLFDKMLKKEALKIRRVHQKLQRSFSGIKNMNGLPDALFVIDSKHENIAIKEAKRLNIPVIGIVDTNSDPDYVDYLIPGNDDATRAIRIYLNNIADIIIQTKEISHPLKENKKIFTNPIIKEKKNIFLKKQNKKILDIKK

SEQ ID NO: 223 - protein, 281 aa, Candidatus Endoecteinascidia frumentensis
MKLIEEIKNLRKRTGVSIILCKDALYKANGDIEKALQIIYNSEKYKSVQKLSKKTDEGIICLEMSEDKKKGVMIEVNCETDFVSRNKEFLNFAKQITKNILNSKNRSSDISYLLSTELKNKKSIEEYRKELSFKFKENIKFKRASIFQTKKKLGGYIHRNRIGVLVELENSNPYICHDIAMHIAAMNPYVIDINDFPLKVIEEKRKNFFLEINKKEISEKIKEKIVLGKINKFLNQNSLLQQDFIKNPRIKVLDFLGKKNKILRYKRYSLGEDIKNSFIPF

SEQ ID NO: 224 - protein, 241 aa, Candidatus Endoecteinascidia frumentensis
MFKKKKSRVLLKLSGKAFAGKNLPISEDKIIFCVKQIVEAYNQGIQICILVGGGNFFQGKKKSPNSLISRITYDYMGMTSTLINGLALRDILKNYQIKSKIFSSISINGITEHFSSFIVEDYIIHGGIGIFVFGTGNPFFSTDTAASLRSIEINANVLLKATNVDGIYNKDPKKYNDAILFKNISFDTALKRNISVMDANAFSQCKDYNIPIVVFNFQKKMAIKRALLGEKEGTLVNFKGE

SEQ ID NO: 225 - protein, 185 aa, Candidatus Endoecteinascidia frumentensis
LIINILKKTKHRMKKTINSFQNTLDTVQIGRAHPKMLENISLEYYGNMVPIAQVATITIINYQTLSISPWEKKNLVKIKKAILVKNIGLNPVISEDIVLVPIPPLSEDRRKEMIKFIYKEAEKFRISLRNIRRDTKNYIKELIRKKIFSDDVLYSSEKQIQDLTNKFLEEINNLIDIKKNILLKK

SEQ ID NO: 226 - protein, 264 aa, Candidatus Endoecteinascidia frumentensis
MFLRILTGIILLILSIIFCFFIPNNIFKYLIDIFFMIAIYEWANFIISNLYIRFIYVISYFLIIKNLIIFFYPIIYLSLIWWLLIGFILIYLPLKKMIFLKNPVVYFLIGLFLFTPAWLSVIKLYLRNPWFIFTVIFYVSLNDSAAYFIGSKWGYTKLSPTISPNKTFEGFFGGIFFSLFLGKIIFSILEVTIYKNIFWILLFLITVLFANIGDLFVSMIKRLFKTKNSGYLLPGHGGLLDRIDSLCAALPFFSFSIFFLTKKF

SEQ ID NO: 227 - protein, 337 aa, Candidatus Endoecteinascidia frumentensis
MIRIDKKNAILTKEFKSFDMVTRPKYFVEYKGQKNICNQMKIFIHAAMSRKDSLDHTLILGSPGLGKTTLANIISNEMGVSIKQTSGPILEKPGDLVALLTNLEKNDVLFIDEIHRLKSSVEEFLYPAMEEFKIDILIGEGIGKRSVKINLPPFTLIGATTRDYLLTSPLRGRFGIIQRLGFYNVEDLTQIIMQSSKILNINIKKEAAEEIAKRSRGTPRITNRLLRRVRDFVEVRFDGILSKETVKYALNFLQIDSLGLDYMDHKILSTIIQKFNGGPVGLKNLSIAVNEDKNIIEEIIEPFLIQRGYIIRTPKGRLVTNLVYQHFNNYFPFIQNK

SEQ ID NO: 228 - protein, 464 aa, Candidatus Endoecteinascidia frumentensis
MNYFKKNFIDNISVLPHSINAEQSILGILMIENNVWNKVFQIIDSNDFYIKKHKIIFNIISQLAEKSKPFDIINISNFLEKNDELNNIGGYAFLKELTDMIPSIRNISSYVDIVKENSILRNLIMTSRTIANKSYYPGTKNSKELVNKAVELISSIAKKISFEKSYPVGIKKIVSNIKKDFQDKKNIKNSKISGIKTGYDAIDKMTSGFQEGDLIIIAGRPSMGKTLLSINFAENIALNSKDPVLIFSMEMSKESLVQRILSSLSRIDHSSIRNKNLNNQEWNKLFNETIPKIENMQLYIDDTPSLTPFELQFRVRQFIYEYKNINLIIIDYLQLMKISDTFQNRNYEISEISRNLKALAKEMNIPIIVVSQLSRKLEIREEKRPINSDLRESGAIEQDADVIMFIYRDEMYYENSKDKGIAEIIFGKQRNGPTGKIKLTFTGKYCRFDNYYSGNYSPSSYYIL

SEQ ID NO: 229 - protein, 421 aa, Candidatus Endoecteinascidia frumentensis
MQVSIDSYSKIYKKILFSIPRKYIQDKIQKKINSISSNINISGFRTGKAPKSIIQKFHGNHLQNDVIQKIIKNNLYKVIVDNNIMIIGSPKITINKNTKNSDLVFSAIIETYPSVNFDIKNIEIEKIVSKITKKDIDKMINKLRKQHPDWKLVKRISKLYDKIVIDFNGSLPNKKKFQGSSGKNVSFILGQSNTIDNFMNQLYGLKEGEKKKIHVSFPKNYKDKIISGKTVIFDIFVKKLYEPVYPILNNNFSNKFNFPTLDMFFSEIQKTMENQLENLLFQKNKENLILILLKHYKITDIPPTLIKNEIDFIKNTKFKDKISEDIIESKAKERAILNILFTKAVEFFKITVSENQIQLYIDKISQIYENPKGLKESYLKNIEKIQEIKQNIQEKMVVEALFNSMNSKFKNVNFYDLMENN

SEQ ID NO: 230 - protein, 202 aa, Candidatus Endoecteinascidia frumentensis
MKNINSLVPIVIEKTGYGERSFDIYSRLLKERIIFLIGTINDCMANLIVAQFLFLESENPNKDISLYINSPGGLVTAGMSIYDTMQFIQPDVKTICIGQASSMAALILTGGSKGKRYCLPHVSLMIHQPIGGYQGQASDIKIHAKQTLKVKDMLNKIIAKHTKKDIFQIEKDTDRDNFLDAQDAKKYGLIDKILNERTIKKK

SEQ ID NO: 231 - protein, 409 aa, Candidatus Endoecteinascidia frumentensis
MNNKNHDKIKNDDTHCSFCKKNRFEVKDLIKGASAFICTECIYACLKIIQSKKINTNKKNNDFLYQKPIDIKNYLDKYVIGQDYAKKALSVAVYNHYKKISNMFEDIEIDKSNMLLIGPSGCGKTFLVKSLARILKVPFAIADATTLTESGYVGEDVESILQKLLHNADYDLDYAKKGIIYIDEIDKISRKSENTSITRDVSGEGVQQALLKLIEGTIASVPSKGGRKNPQQEFEKIDTSSILFICGGSFSGIENIIKERTEKSNIGFNENILLDDNKNNSKLIKKVEPNDLIKFGLIPEFVGRLPIIIIFDDLDENDLIQILTTPKNALLKQYKYLFKTEKIEIDFKKDAINMIAKKAINCKIGARGLRSILEDILLETMYTVPSYPKIRKIIIDKDVIQLGKKPQLI

SEQ ID NO: 232 - protein, 787 aa, Candidatus Endoecteinascidia frumentensis
MEELKKCDIITKNKTIKKQLPVLPLKDVVIYPYMVIPLFVGRNNSINALEVAMKKDQKIFLVAQKKSEDESPNINDLFCIGTISSILQLLRLPDGTLKVLIEGEKRAKLIHILEHDNAKEYLFCEVEEINDFICKNIQLEALSRFLISQFDQYMKLNKKISPEIFSVLSGIENPSRLSDTIAAHMSIKLQDRQMLLEEEDLEKRMNSLLILLEHEIDILQIEKLIRKRIKKQTEKNQKEYYLNEQMKAIQKELSQSDSEYDEIKNLEKRIKKSKMSSDAYEKVLKELKKLKTMSLISAEATVSRNYIDTLLEVPWKQKSKIKHNLIRAKNILNKDHYGLVEVKERILEYLSVEKRVRKLKGPILCFVGPPGVGKTSLGSSIASATGRKYTRISLGGVRDEAEIRGHRRTYIGALPGKIIQKISKSKVKNPLFLLDEIDKMSTDFRGDPSSAILEVLDPEQNISFNDHYLEVDYDLSEVMFIATANTMNIPLPLLDRMEIIRISGYTEDEKINIAKKYLIPKNIKACGIKNNELYLEEKVILSIIRYYTRESGVRNLEREIAKICRKVVKKILESSKIKSITISNTNLQKYLGVRHYRYGIKSAKNQIGQVTGLAWTEFGGELLQIEAFAMPGKGKILRTGKLGKVMQESIQAAVTVVRGLPEYYKIPSDFYENIDLHLHVPEGGIPKDGPSAGIAMCTAIVSVLTKIPVKSDIAMTGEITLRGELLPIGGLKEKLLAAHRGGIKSVLIPKENSRDLQEIPDNIKVDLDIIPISWINQVLDKALVSYV

SEQ ID NO: 233 - protein, 523 aa, Candidatus Endoecteinascidia frumentensis
VILQKIRKKISNWFIWIFIIISIIIFSAFGINYFFNKKIYDKDYIAIVNNEFISRIEFLKIYENYKNQFLNKKNNKKNILEIKNKILKKLIINKLLIQHIKNIGMTLSNQYIDSIISNFPIFQKDKKFSLKKYHKYLEYTGLNTNIIRKNLLNFLIKNQFYLGIKISNFAMPNEIKRQAILESQIRNFRYIKISDAKFNKFNSISDNEKKKYYNSHKELFFEKPKIKIAYLIVFMEDIINSVNIKENEIQDFYKKNSKKYFKDFNIEKIKIKKYLKYKKSKYIFNHIKLQLNDLSQKNPHSLSYIASILHLKIINTGWISKNNKYNTGIFKNPKLIDISFSDRVFKKGYNSKVIYIPNLKAILVLRIIDYNIKKIKKFNAVKNFIEQKIKKEKSIYKVNNIAINLVKNLNNNKNIYFLMKKFHLKWIYENNISLHSNKMNFLTKKAFSQIFLKKCFPYKAIIFRNNHYFYILQVTKIHFNEKPKISLKYQEILRKKILNIWFEYEYNKYISNLYKNASIKYNL

SEQ ID NO: 234 - protein, 262 aa, Candidatus Endoecteinascidia frumentensis
MIKIKIRNFFQKRINNAIHPLTKKLFQLMEIKKTNLALAIDVTNSSELLYIADKIGPEICLLKTHVDILKDFSTEVTKKLSILSAKHKFLIFEDRKFSDIGNTIQMQYKEGIYKIFYWADIVNSFGFSAQGIIDILKKEKSFQKKRGILLISEMSNKNYFFSKKNRIFCYKLAKKYPDFIMGFICQEGFKDIRFIYLTPGIRFQHDKDDFDQKYRPPEEALIKQNCDILIIGRGILQSKNLIQETKKYKIKCWDIYLRKILA

SEQ ID NO: 235 - protein, 54 aa, Candidatus Endoecteinascidia frumentensis
MLILTRKIGETIVIGDNITVTVLNIKGNQIRIGINAPQDIQIHRNEIYQKIKNN

SEQ ID NO: 236 - protein, 462 aa, Candidatus Endoecteinascidia frumentensis
MDFFETFLNITPIDGRYKSKCKKLNIFTSEYGLFYYRVKIEILLLKEFSSLPLVKECPLLSKDQENFLNRIVKNFSKKDFYTIKKIEKFTQHDIKSVEYFIKNKLAERQDMKNYVEFVHFACTSEDINNLSYALQLLDCRDKILLKEFKIIAEKLDMMSYMYAKLPMLSRTHGQSASPTTLGKEFRNFEQRLVRQLNLLSNIQIFGKFNGAVGNFNAHVISFPEIDWIKFSKNFVTKILKLNWNPHTTQIEPHDYIAEYFHNLIRINIILIDLCRDIWGYIALGYFKQNIKKEEVGSSTMPHKINPIHLENAEGNLGLSNALLNHMAMKLPISRWQRDLTDSTVLRNIGTALSYIVIGIKSLQKGLNMIEADLTIISKDLNENWIVLSEAIQTIMRRYKCKTPYEKVKEFTDGKKKISKKDLYKFIKSLNLSQSQKNILYKTTPSNYIGYAIKLSQFKLFSL

SEQ ID NO: 237 - protein, 315 aa, Candidatus Endoecteinascidia frumentensis
MNDLIIFSGNSVPYLAKDIAKNLSLPLGKAYVGKFSDGEIYVEIQENVRGKDVFIIQSTSPPTNDNLMELIIMSDALHRASANRITAVIPYFGYARQDRRLPSSRGPITSRIVADIISASGVNQLVTVDIHAEQIQGFFNIPLDNIYASPILISHIKKKKLENVIIVSPDIGGVIRARIFAKNLDCDLAIIDKRRIHANTSQVMNIIGSVKNRHCIIIDDIADTAGTICKAAEALIQKGAKRVSAYCTHPVLSKDALNNIEKSMIDEIVTTNSIMLSSSSIVSSKIIQLNLSKILSETIRRINSEESISSMFKHL

SEQ ID NO: 238 - protein, 63 aa, Candidatus Endoecteinascidia frumentensis
LPIQIKKYLAGPPGFEPGNAGIKTPCLTSWRRPIFKIKNFMNKIIKFQENFTYKKIFNIFIII

SEQ ID NO: 239 - protein, 197 aa, Candidatus Endoecteinascidia frumentensis
MLNLAILGSGNGNTLIPIVNAIKNKKLNAKIVIIISDCINAGILKKATKFQIKKKYILSKNKEMRKDFDKKIHLELQKHKLDLIVMIGYMRIVSHWFIKKWKNRIINVHPSLLPKYSGLMDLQVHKAVLKAKEKKTGCTVHFVEKNVDTGYVLKQASCSILKNETPESLKIKIQKLEGKTLINVINEIQTNNYFNLN

SEQ ID NO: 240 - protein, 431 aa, Candidatus Endoecteinascidia frumentensis
MFIKKKKILIIGSGAREHAIAKSLYSSKSLLYCFATNLNPGIFSLCIGYLIGNIKDIKYITDFGIFFNVDFAIVGPELPLSLGIANSFNKAGIKIIGPVKELARIESSKGFARDLLKKNNIPGLIKYKRFDKVNLETKKFLLELSEEYVIKSDGLEGGKGVKVANKDLFSHEEALKFCSNINGPFVIEEKINGLEFSLLSFSDGNTLQHMPIVQDYKRAYTNNLGPNTGGMGSYNDSNHKLYFLSSEDINLAKKINELTILALQKNCNCKYKGILYGGFIKSKNRIQLIEFNARFGDPEAINLLSILNTDFLDICYAIINTSLHKLNIKFLNIATVVKYIVPNGYPNNSVQNGIIDLSYINNDNSLFFGGVNQKNSKIITTSSRAIGVLGKNINIMQAEQEAEYMASKIFGPVFYRKDIGKFQHHIKTSII

SEQ ID NO: 241 - protein, 516 aa, Candidatus Endoecteinascidia frumentensis
MNKNSLKIKSAIISVYNKHGIKKLAQELNKRGVVIYSTSGTKNYLKKASIKTFSIKKLTNFPEIMEGKIKTLHPKVHGGILGERNNDIKDISHHNIHWIDLIVCNLYPFFEIIQKENNIDKIIKNIDIGGSAMIRSAAKNFEWVSVLIDPKDYNLIISKLDSGVDFIQRKNFSIKAFSYTSKYDFTIFRYLSKKENINKNTYFSKKFIFKSNKIYDLRYGENPHQKASLYSNSNSCKELFIKNKIQGKPLSYNNIVDSSVAIKCLYEFKEAACVIVKHGSPCGVSISDNIDTAFQQAWEGDNISAFGGIVALNKPCTLKIAKFLIHNFIEILLAPRFKKSILLILSKKPNFQIIDLANYQYKKDSFFLQQVLDGFLLQETNQYNIINDDLFVPTILKPNKSQLKDIFFSWKVIKYIKSNAILIVENRKTLGIGMGQMSRIDAVKFAILKAKNKISISSILISDAFFPFPDAIKLISNAGIKIIVQPGGSIKDKININICNKYGLIMLFTGKRCFTH

SEQ ID NO: 242 - protein, 153 aa, Candidatus Endoecteinascidia frumentensis
MGSKSDWPIMKFSAKILFKLHINYYATIVSAHRTPDRLFQFAESLEEKGYEVIIAGAGGAAHLPGMLASKTHLPVLGVPIKNTDLQGLDSLFSILQMPKGIPVGTLAIGKAGAINAGLFAASILSLKDKKIRNLLINFRKEQTENILKNTEII

SEQ ID NO: 243 - protein, 365 aa, Candidatus Endoecteinascidia frumentensis
MITIGIIGSGQLAQMITHVAYTLSIKTLCYSQNKNCPASIFSPIFVGDFFDLHAIKSFVKKVDIVTIENENIPKFFLLNISKYIKIFPNKKSIFISQNRLLEKQLFKKLNILTTKFIKIYNFLDLQKSIDTFPLPAMLKTQYFGYDGKGQYFISHKNQIFNAWKSLQKKPCILENIIPFSEETSIIAARNSLGNIQFYPLIKNKHISGILYISTLDSNTEHPLQKKAEKIIKNLMEYLDYIGIMVLEFFVFKNELIANEIAPRVHNSGHITLNACNINQFEQHLRSILDMPLLKPLVLYDSAMINILGKNINIKAKNIFPEIHVYKYRKEEFSRRKLGHINITASSTEKREKIINQILKKFPPIL

SEQ ID NO: 244 - protein, 245 aa, Candidatus Endoecteinascidia frumentensis
MIFFLFIRSTLFLFFITILSIFWCLLLYLSLAFTFKVRKYLFYIWSRLILISIKIFCGIKYKIKGLENIPKNKSIIFFSKHQSAWETFAFLSLLPNSCFILKKSLLNIPFFGWGMRLGRHIAIDRKLGIYSIKKILKLGEKRKLEGLSIIIFPEGTRTLPNEHPKFYTTGIVLAQKTKSKIIPIVLNSGKFWPKNKWIKFPGTILVLIGKSIDVVNLDRKVINKYLYKWIKNNSIKLEEIFSKFD

SEQ ID NO: 245 - protein, 49 aa, Candidatus Endoecteinascidia frumentensis
MSAENSIYQKIPQAVIFPKNNLDIQILFSILKYSYLFFIKYNNFENTIV

SEQ ID NO: 246 - protein, 46 aa, Candidatus Endoecteinascidia frumentensis
LKLFGKKIKENSNLPLVIEYSCRFQMKRCTGIFAKNPIEILNSILE

SEQ ID NO: 247 - protein, 324 aa, Candidatus Endoecteinascidia frumentensis
MYLLLHSIFNKMLENISLEILNVTESAAIASFKEFGLCNEQKADKEAVDAIRKSFKNIGICGTIVIGEGERDNAPMLYVGEKVGNQKGGKYDIALDPLEGTSLLANGKPNALSVLAISEKGGLLKAPDTYMQKIVIGLDNPRIVDLDESIVINLQNLAKAKKTSVKSLTVCILNRPRHYPIIESIKTLGSKISLIDEGDILGGISTSKYFNTGIDMYVGIGGAPEGVLTAAAIRCIGGFMQGRLLFQNSDEKNKAKKLNIQNLNRKYNLQEIVSKDLIFLATGVTDSFMLKGIKKNTQTSIIDSIIMYSKTKKIQKITTCISNK

SEQ ID NO: 248 - protein, 223 aa, Candidatus Endoecteinascidia frumentensis
MKNIKSYFRKRGRITNLQKKSLEKFWHTYGISVEDRKIKHGKIFTNNFPIFCEIGFGMGDSLLNQAIQFPNVNFIGIDIYQPGIGSLLHNIKKYNLTNIRIYCHDAVEVFEKCIPDNLIQKLQLFFPDPWPKKKHTKRRIIQKDFINLITKKVSYSGYLHIATDSKEYMKHILKIIKYPWIYQENIQNIPVLYTLRFPSKFEKRGKKMHNKIYDIIFILSDIV

SEQ ID NO: 249 - protein, 452 aa, Candidatus Endoecteinascidia frumentensis
MKIIILGSGQVGTSLAKNLCLEHHVTIIDKNPKQLFRLQNQYEIHGVIGMASHPDILKKSGAETADMIIAVTSSDEVNIIACQIAHILFNIPTKIARVRSRELLKYPQIFYSKNKFINTIINPEQLVIQRIIRQIEHPGTINILDFAKGNLKLASIRVTPFCKLIGSRIKELYQSLYKRDIAIIALIRNKNVFLAEDNLLIEVHDELYFFTRTKDINNITQILLNKEQEYHRIIIAGAGNIGSGLAKELEINYNVKVLDHNKSHCENAARLLNRAVVLNGDVSDIDLLFNENIDETDLFCSVTNDDETNIMSAIIAKRLGVNHSIALVNSSTYVHYLIERSPDIDLAISPQQITKGKILTFLRKGDMVNVYPLPRCTAEAIELIIHADKNHSNIVGCAIENIKFPFTTIVMGILRRENVIFLPTKNTIIQENDHLFLFVGNKSNIAEIENLF

SEQ ID NO: 250 - protein, 244 aa, Candidatus Endoecteinascidia frumentensis
MIIPITISIYYQEKNVFIFIKSFFFIFFSGLFLYMIGFYTKQELKNCDGFLVVFLIWIFLGISGSLPFLFLKNSNFDFSKSLFESISGLTTTGSTIITNFKNLPKSLLYYRQQLQFFGGIGIVVLAIAIIPIMEDEINLYKIENTDPMKNNQFYLKFYEKAKELWKIYLLLNFFCIIAYWAICKMNFFDAVSFAFSTISTGGFSPYDQGINHYTSFTTHIISIIFMLLGSINFSLHYFFLKKKR

SEQ ID NO: 251 - protein, 201 aa, Candidatus Endoecteinascidia frumentensis
LCFIISIAIILILRINKIYHFPKILVYSFYQVISVFTTTGFSSSKDFINWPIYLIILLIFIGIIGGCSGSTSGGIKFIRIILYTKQIFQEIKYLIHPYGTFPIKLDQDIISKKIISSAWSFLAIYIFVFLIMWILLISFGLDFKSAFFSIATCISNTGINLGINFSKIGNLSQYLLSFAMIMGRLEFFSILILFSPIFWRR

SEQ ID NO: 252 - protein, 417 aa, Candidatus Endoecteinascidia frumentensis
MKKNTNIGFFIFFLGALFYCYEYFLRISPSVMQHQLMQSFLINATLFGTLSAFYFYSYTPMQFFVGLIVDKYDIRIIMIISIFCCTLGTFLIGNTHIYLLASFGRFLQGIGSAFAFVGSLKLASIYLRYDKFANFTGIVTMLGFLGASIGTVFMENMVEKIGWRHTLHIFTALGFLLILAFFISIKSSYNKNFSITPNSESFQESLKKFWLICKIKRLWFTGIYAGLMFLPTSVFAALWGIPYLEKLHFYSVHKSSIAVSMIFLGWSLGSLMIGILSDYLDKRVILLQIGSFVAFWIVLPILYIQSMPYIIVCLMFFLFGAFSSVQILSFVIAKDISPYHSVGTSIAFVNAITMLGGMFFQRGLGEILDWSWSGKIVNKIPFYSLHDYKIAISVIPISVGLAFFISFLLKKDQKFIE

SEQ ID NO: 253 - protein, 184 aa, Candidatus Endoecteinascidia frumentensis
MISKIKYIAFYMLYYRNSIINIINKNHISSLLEINKHFLHIHNIKILCLDFDGVLGFYKSNTILPKIKIWLKYITSIFSESCIYIISNNHYHKREKYFIDRFPGIHFIKGFPSKPYPHSLYKIVSISNIKPKNILMVDDRLLTGILASCIVGTKSLYITLPYAKKSFLEFYFHFLRFMERLFFI

SEQ ID NO: 254 - protein, 461 aa, Candidatus Endoecteinascidia frumentensis
MLITRFSPSPTGSLHFGSIRTALFSWLYAKQKKGKFILRIEDTDLQRSNNYFSNLILDVMNWLKISYDAGPFFQQSRKKYYQMYIQKLLKSGYAYKCYCSKERLAKLREMQILKKQNPKYDGYCRNKNIKNSNFYIIRFKNPKNGRVIWYDLIKGKIEISNSELDDLILSRSDGSYTYNFAAAVDDHLMKITHVIRGDDHVSNTPKQINILQAIDGFIPKYAHIPMILDKNGKRLSKRHNTTDIIEYRNLGYLPQSLLNYLIRLGWSHKNKEIFSINEMIKYFKLQNVNQSASIFDINKLRWLNRYYINSLSYEDIKEEIKRHFLNANIDIHNGPKLKNVFLLMSKGTTTLVELAKKSKFFYQENIKININLEKKYFSYETHKHIKYLYQKLFSIEKWESLLIFQAIKNTMKKFHLNIKNIAMPMRIIITGFDNSPSISHIAELLGKYRCLSRIQNFLSMN

SEQ ID NO: 255 - protein, 599 aa, Candidatus Endoecteinascidia frumentensis
MKKIPIIVGFGGINSAGRTSGFHSYKRIIHSFLSNKEMQSTWLDLANRMKIKQKKNYINKILKGTLIRKIDSFNPDAVIDYFNLAYSSESLPNIKFKISTFRLPSPIPSNWNLLKINKDIASIEIKNPKEILVPISKKLEVTTAGNIPKGFNPGSLYNSLYHPRSLQLGVYGISDAINSLGLDWENIMHYISPDKISVYAGSALCQSDENSLTGLSINSKIGKPINAKMIALSFSEMTADFINSYIINSVGNTGSNMGACATFLYNLRMGIQDIQLGKARVVIIGTSEAPISPEIIKGFSRMGALAKDKNSIKLNKNIDYSQICRPFSENFGFTISESAQFIIIMDDDLVMKIGANILGSVENVFINADGNKKSITSPGIGNYITIAKTVSLCKKIFGEKELNNTYVQSHGTGTPQNRVTESHILNTIAKAFSIKNWPVTAIKSYIGHSIASAAGDQISIALGVWKFKIIPGITSIDCIANDVHHDYLDILKNHKYLDKPPVAAIINSKGFGGNNASALLISPEKTIEMLKYKYQKNIWKEYQKKYIKILDKIQEIDKSSCEGKEKIIYNFGKSILSEKFLKLNTNQIYFSDSNLIIPY

SEQ ID NO: 256 - protein, 238 aa, Candidatus Endoecteinascidia frumentensis
MKIINISGYKFLHIHDVFLQREKMYEKLGDIGLLGKVMISYEGINIMLSGDKKQIKEFYFFIKKDLRFTGISFKKSYSDYIPFNELKIKCKNCIVPSKFDIFPTIQNKNTITPKIFKWLLDYKKNITILDIRNKYEIDKGFFYKSIHLNINQFRDIYTKLKNCSEKIKNIPTIMYCTGGIRCEKAIILAKKANFKNVYQVNGGILQYFKDIGQKYFQGRCFVFDNRESITAEDVKYPQ

SEQ ID NO: 257 - protein, 196 aa, Candidatus Endoecteinascidia frumentensis
MGLEIMNIWILPNFLTFLRIFIIPFFLLFCYLPFYFLHDIAIVLFLFSALTDWFDGYTARKMDKISSFGAFLDPVADKLIVTVAFMIIISKYHEVWIVIPIIINIIREILISALREWMAKIGNSHIVNVTYLGKIKTTIQMIAIIILLKQISINRLTIFGIILIYLSTFITLWSLIIYMKSAYPFIQSIKSIKNKS

SEQ ID NO: 258 - protein, 284 aa, Candidatus Endoecteinascidia frumentensis
MQFAKNLLSITKPGIVIANIITTSGGFIVASHGRDFNYFSYFFTILGMFFIISCGCVFNNYIDQDIDQLMQRTKKRVLAQKLISLKTAFYFGIILGIIGFIILLIFTNILSLIIALFGLFVYIILYSFWLKRCFIYAIIIGSISGGIPPVVGYCAATNSLDKIAIILFIILFFWQIPHSYSIGILYIKDYDTANIPIIYLIKNIKKTKIYILLSSLGFIFFTTIFYILEYKKISYILIPICIGIVWILIICKGFFVKNNIFWARNLFLITILTLIIINITMLIL

SEQ ID NO: 259 - protein, 111 aa, Candidatus Endoecteinascidia frumentensis
MIKKKKQPLIESEYTFKSYLFGFFLSVILTIIPFFLIMQKKYSYSPFQYKCFLFIFAILQFFVHSVFFLHLNIKKKGMWNFLVFIFTIFVIFILVFGSIWIIHNMNYNMLY

SEQ ID NO: 260 - protein, 199 aa, Candidatus Endoecteinascidia frumentensis
MEKIKKKLNKEIMSSKEIFGFWIYIMSDCVLFSTLFAVYIILHKNTFGGENIQNISNLSYVFCETIVLLTSSFTFGMTMISMYKNSYNKIKTIFWLTMTFIFGLIFISMEINEFYQLFLEGNTWEKSAFLSAFFTLLGTHGLHVTIGLIWILVMIIMIYTKNMCFMLEKKMICLSLFWHFLDIIWIFIFTIVYLLGYIE

SEQ ID NO: 261 - protein, 652 aa, Candidatus Endoecteinascidia frumentensis
MRLLGNLSLNALPSNPIIIGANIFMGLFILTIIFMLFYFKKWTWLWKEWITTVDHKKIGIMYIISALVMFVRGFSDAILMRLQQVFSFGHSFGYLPPDHYDQIFTAHGVIMIFFMAMPFMFGLVNIAIPLQIGARDVAFPYMNSLSFWLFLVGAFLVNISLVIGKFAGTGWLAYPPLSGIIYSPGVGVDYYIWALQISGIGTLLSGINFFVTIIKMRCPGMSFMKLPIFCWTTLCTMILVIIAFPILTATLGLLFMDRFFHMHFFTANMGGNAMMYVNLIWAWGHPEVYILILPAFGIFSEVTATFCKKKLFGYTSMVWATVAITFLSFIVWLHHFFTMGAGANVNAFFGIATMIISIPTGVKVFNWIFTMFRGKIEYHSTILWTIGFIITFTIGGMTGVMMAVPGIDFQVHNSVFLVAHFHNMIIGGVVFGYFAGLTYWFPKIFGFRLNEKLGKYAFLFWLIGFYIAFIPLYILGLKGMTRRLYHYSIESGFHPYLIVASLGTCILGIGILFQIIQLIVSFKNRKNINYISTNDPWNGRTLEWSISSPPKFYNFLILPKITYRDDFWEKKEKLKYNFNNKKHIVKTFHMPKKTSTGFIIGFFSSFLGFSIVWKIYWLIGISAIAIILSIIIRTFNFDIDYYVDVSKKKINC

SEQ ID NO: 262 - protein, 300 aa, Candidatus Endoecteinascidia frumentensis
LNYKLSVFINFSKKILFILIICFLFLILSGCTLEILNPKGYIASQEKILILFTVFLMLLLIIPVIIITIIISIYFRESNKKTLYKPNWSHSILIELICWIIPCIIILILSYFTWITTHKLDPFKSLNFQKKPLLIEVVALNWKWLFIYPKQHIATINFLQIPVNIPIKFKITADAPMNGFFIPQLGSQIYAMPGMQTQLNLIANEKGIYKGFSTNYSGIGFSEMKFSVHVSSLKNFENWISQIQKKTFLILDKNQYLQLSKPSIANTVTLYILKNNQLYKDIIKKYTKYKSSNLISNQNL

SEQ ID NO: 263 - protein, 97 aa, Candidatus Endoecteinascidia frumentensis
MNIGKFFTKEYWKVEKNYQIFLILLTFSISGFFSMYIADIFMKIIGFDKNHTISYIFWPLRILCIFPLYQISLLIIGTILGQFNFFLYTSKKYGEIL

SEQ ID NO: 264 - protein, 397 aa, Candidatus Endoecteinascidia frumentensis
MFNRILGSTLFIIGISVGGSILALPIVTNGIELKIITLISISICFIMMISAFWIMELNLSISGNSNLITMAQSTLGKSGAIIMGILYMLLLYFLLSLYLEGGGELIKSLLYQLLGYKLNNYMSTILFITIFSFVFYNGIKIVDWSNRFLMAIKLSSFFLLLIMLIPYESIKNINSIIYHVNSLNFIMPIISAFGFSIIIPSISIYLKKKRKKILLVIILGSIIPLILYLIWIYSIRSTLDSIELYSISQSKNIIFYLSNSLCKNLNSIYIQFLIHIFMSICITTSFLGVSLSMLDFILDIFPKKKIKQYKKIFHFLSINIVFIPPTIIVMLYPGLFIPILQYIGILCIIILIIFPALMNISAIYIKKIILYPPFYCNGFFIIFIFIFAIFALVLSLH

SEQ ID NO: 265 - protein, 399 aa, Candidatus Endoecteinascidia frumentensis
MFKNKIIGGILIISGTSIGGGMLGLPIITSELGEFYTILLLFFSWGLMTITAFLTLEVNLCFPQKSNIPSMMEKTLGNLGLIIGWSIYILFLYSLLSAYISGGTDIFQGFFIFLGLHLPYWFSGLFFAIFFGIIVMKGISFVDKFNRFFMTIKILSLLFLIFFILLSNMNEHNFFPKKILNIAPSISISITSFGFSIVVPSLRTYFKDNIQSLKKVIFFGSLIPLFFYIIWIHVIFSTIPLHGENGLIYIKNSLNPITTLIKSLHIITKNNRIHFFSHLFISICIITAFLCVSLGLSDYIADGISCEKKGIGFYIIAFITFSPPLFLLLFFSNTFIYFLKIAGMLCILLQAILPIFMSWKVRYHQKKIFFYQVFGGKTILIISLTCSIIIFIFSVNSLF

SEQ ID NO: 266 - protein, 608 aa, Candidatus Endoecteinascidia frumentensis
MNDIGKNILVWILIIIALLAIFSNFAPNMGTRIEKMTYTNLIHNIKNNQIESVQINQNNILGTTKDGRYFNTYIPWKDPILLNMMINHNVEIVANPPSKRGFFLSILINWFPFILLIGVWIFIMRQMGSGKGGGAFSFGKNKAKLMNEEEIKTRLSDVEGIEEAKLEISEIIDFLKDPDRYRKLGGKTPHGILMIGSPGTGKTLLARAIAGESGVPFFSISGSDFVEMFVGVGASRVRDMFNQAKKKAPCIIFVDEIDAVGRHRGTGLGGGHDEREQTLNQMLVEMDGFTENEGIIVIAATNRPDVLDPALLRPGRFDRRVIIPLPDMKGREKIIRLHMKKLPLDQNVKPEFIARGTPGFSGAELANLVNEAALFSARLNKTTVSMNEFEKAKDKILMGTERHSLAMNEKEKYITAYHESGHTIVGLLVPDHDPVYKVSIIPRGQALGVTIYLPERDYMSFSKQKIESQLSSLYGGRIAEELIYGKQHITTGASNDIERATELARNMVKKWGFSDKVGPLKYSENNNQPFLGHTIGTSSVNDFSDKTAIEIDSEIRNIININYKRAKKILEDNIDILHAMANALIVHETLNAKQIDDIMNQKNKNNGK

SEQ ID NO: 267 - protein, 287 aa, Candidatus Endoecteinascidia frumentensis
MCYFFSKIVKKIPKIMGILNADPKSFIKNSQVFNTAQAIDKTYKMIKHGADIIDIGGEATNPKITNNSRERIISVEEECDRVIDIISAIHKRFHIDISIDTSHPKVMKMAVEKGANMINDQRALTLPGALEEVSKLNVPVCLMHMFGKNNPNKFYHINDYYKMLKEISLYLKMRIKNAIAKGIKKKNIIIDPGLGGGIYGKNTKQNLFILKNLNFFKKNDFPVLVGFSRKSMVCEIIKSSPKNALFGTIALSVIAMQQGAKIIRLHDIKENIHALKMILATNLAGLV

SEQ ID NO: 268 - protein, 284 aa, Candidatus Endoecteinascidia frumentensis
MSLPKISFLGCGRLGKTLAKLWYKNLVFQIQDILTQTYNSAVDARNFIGSGRPVKSYKDIVSSDWFCIATNDIQISNIVKKIKKFNFIKGKKIIHFSGCLSSYVLNPLKKMNCEIASLHPALSFSQPEFAYYQFPGTYCTVEGDLSLVLRIREIIEKIGGKFLHINAQDKPAYHTACCFSSNFIYSLMQYSISILINIGFSKKKAKNLSVSILSKSLDSLKKTNKILLTGPINRGDINIIKKHIKTLKNTIWSKPYRMLSLEIIHYASIQRKKKKNIINLLKKF

SEQ ID NO: 269 - protein, 259 aa, Candidatus Endoecteinascidia frumentensis
MKKKVIIANWKMNGSYSFAINFSKKLFNYVKKDVEIILLPSFIYLYSMKNILQKKILLGSQDISFNKSGAFTGEISASMLVDIGCKYSLIGHSERRKLHMENNFIVAKKFKIAKLYGISSILCIGESLQEKERAREIEVIRKQIYAILDIIQPEEWGETIIAYEPIWAIGTGKFANPKHVQKVHIEIRNVLNEWSEFYTRNTRIVYGGSINSTNVINFLKLSEIDGFLIGNASLIFEEFLFIYKLCVKKYSNNLLKLNT

SEQ ID NO: 270 - protein, 449 aa, Candidatus Endoecteinascidia frumentensis
LAYQILSQKWRPKTFKFFIGHKEIISGLQYALNNNKLHNTYLFSGTRGIGKTSLARIIAKCLNCEKGISDNPCEICNICKSIQLGCFSDIIEIDAASQTKVEDIRDILDNIQYPPISGRYKIYIFDEVHMLSLHSFNALLRSLEDPPKYIKFLLTTTELKKIPITVLSRCLQFHLYPLNSFEIRKHLSYILNTENISYNDEALDSISLLADGSMRDGLTLLDQAITVGQGIVDKKSTNIMLGITKKEEIFSLIETLFNKEISLLMEKSKSLNLKNSNFFLILDFMAQAIYEINYYQLSKKIPSNGFLPEKKLILLSKFYPNHVLQIYYEIITKGKETLKNSPTIHMGFNMILLRLISLIPFEINKNFHTLPKQSLKLLNNLDKKEKNIQDNQKKNMHSVFKEQKLNLKKKNNKNKTSNLYQNLLNDKNIIFLQSEFNAVIEKKSIKNIT

SEQ ID NO: 271 - protein, 324 aa, Candidatus Endoecteinascidia frumentensis
MKILADKNIPLLKYFFSNFVESIDTVSPDKFYQKNLLQYDILLIRSTIKISSDILKNARPKIIASCVSGSDHMDLDYLKKESIMYYTASGCNSQSVSSYVKQIINGLINKSLLRHNGKIAIIGVGNIGKKIVKFLQKKNYEIVQCDPFRAIKESKFPHIPIEYITNCDMICLHIPLTFDGKFPTYHIISECFLKKQLLNTIIINTSRGNIIHPNVFFSSQKFIFCFDVWPKEPNIPVDLVQKSYIATPHIAGYTKLGISKGVHMAYNKMSNIFHWPKKDLPNNFKKNIHKNLFQLSNSFKLNIKMKKKTEYIFKKFRKQYMNFS

SEQ ID NO: 272 - protein, 645 aa, Candidatus Endoecteinascidia frumentensis
MNSNNKKSNKKENFSFQTEVKQLLNLMIHSLYSNKEIFLRELISNGSDAIDKLRFQSITNIKLTKEYTDPVIIVDYDKNLGILSIKDNGIGMSRNEVIDNLGTIAKSGTKDFFNSLTGDNVKDSQLIGQFGVGFYSAFMVADKVIVNTRHINVLPEEGVHWESQGQGDYTVEPKKKLHHGTEIILYLKKEHLNLLETFTLKNIITKYSDHISVPIKLREEKEIQEKDNKDNLKEKKKDKKTEIVYETVNLGKAIWLRSKKNITNTEYKDFYRHVSHDFGDPLSWIHNSIEGKQEFVILLYIPKNAPFDLWDRDKKSGIKLYIKKVFIMDNADIMPIYLRFIKGVIDSSDLPLNISREILQKNPLVDKIKSFSVKKILSSLERMSKNQPEDYKEFWKTFGQVMKEGPAEDFDNKELIIKLLRFSSTFDDKEEQSISLEEYVKRMKETQKFIYYITADSFLSAKNSPHLEIFRKKNIEVLLLSDRVDEWLVSNVNEFSGKKFKSITIGELDINQETENKSSVEKKKKHDKNFESIINQMKKVLGAKVKDIRLTDRLTDSPSCVVSDNTGMSMHLQRLMSASGKHIPSSVPIFELNPKHHFLQKLQEEQDDQCFSDWTHILFNQALLSEAGSLADPSEFIKLINKYLK

SEQ ID NO: 273 - protein, 201 aa, Candidatus Endoecteinascidia frumentensis
MTCYAYFHIDKQDENLIFEYALNKKLTIDTIILEYESIKSYWIHREIGRIINTLKTKDILIISDATQLACSVSQVLEILSKIYKNKAKIYFVKYNICIDNIQRYIDIQLFLTLISKIESDFISKRTSQALAKRKETGMPLGRPKGSKNKNLKLDIKNNDIKKYLNLGISKASIAKLVGCHPQTLYNWLKRKKLLKIKKLKS

SEQ ID NO: 274 - protein, 406 aa, Candidatus Endoecteinascidia frumentensis
MLSILLLFSVFIYYINYIYLNIQNTTAITLHAFFFSLIIIFANKMSFFNFETSIKFFLEKVDFKNLLLNIILGLSLFSSSLSINLKKLLDYKWEIFSLAFITTIFSTFLIGTIIYCILFFFKISISYIYCLIFGSIISPTDPISVLSTTKKISTKLDLTTKISGESLFNDGIGIVLFMMFYHMIFNHHLSFINLIFTVFLKETMGGVFFGFFLGILSYNLIKRIKDPKLEVLISFCIATYGYNYAMQINISGPLSMVISGIIIGNFKTKNIITKKGKKYLYIFWELIEDLLNYILYLLIGLEIILLSYKWYYIFLGLSAIPIVLFSRFITVGIPMNIFKIYRNYSPFIITILTWGGLRGGLAIAMALSIPNYSPYYDIILFSTYSVVLFSIIFQGTSIEYIIKYKL

SEQ ID NO: 275 - protein, 59 aa, Candidatus Endoecteinascidia frumentensis
MSDKIYKKFMCVLCGYIYDERYGWPKDGIQAGTKWEDVPLNWECPECGAMKSDFEMIEI

SEQ ID NO: 276 - protein, 462 aa, Candidatus Endoecteinascidia frumentensis
MKIKENKMVNSFDYLVIGSGSGGISSAIQASKYNVKVGIIEGSKNLGGTCVNHGCVPKKIMYFGSMLSSMLHESINYGFSFQKKNINFSWEKLIKNRNTYIKNIHNFYKKKITDNNIKLIQGYAKFKNNKHIIVNDMVYTGKYILLSPGSSPKIPNIYGAEYGITSDDFFKLHKKPKRVVIVGSGYIALEIACMLHALGSQITLIIRYKNFLRKFDDILGGTLMEILKKKISVIPQNKIIQVKKNNTENLTIYLQNKISISNIDCLIWAIGRSPNIAHLNLKNTDICLKNSAIQINKYEQTTVKNIYALGDVTNTYNLTPVALKRGRYLSQRLFNQENIYINYKYVPTIIFTHPPLASVGYSEKFAISKYGKENIKIYTTSFKSMYDTLAMNNIKTAMKLICLGDKEEVIGCHIIGLNCDEMLQGITIAMNIGATKKDFDHTIAIHPTISEELVTMKLRENC

SEQ ID NO: 277 - protein, 263 aa, Candidatus Endoecteinascidia frumentensis
MSNLIDMQDFQENRKLSIHKVGIKDLKYPLIIANKNFEKQNSIGKYTISITLSKNKKGVHMSRFIEVLESISNIPVSIGNLKKIMQKFCDKLESHSSQLQIEFVYFKIKKSPKSFFKSKLAYNTKIKCSYHTPSRINREIEIQIPVKTLCPSSKAISKYGAHNQRSYITVNAEILSKKICFDDIINLVENHASSQIFSLLKREDEKYITEIAYENPKFVEDIVRDISLSIKKCSGIGYFSVECENIESIHNHSAFAYIEDKGK

SEQ ID NO: 278 - protein, 380 aa, Candidatus Endoecteinascidia frumentensis
MNINKKKFFISSLLIISLISIFIIIFMGKIFIKSKITKFIKNYQPVSSVTTQKSKIYFWNSYIESLGIISPINGINISAINNGKIAAILFKSGDIIKKGQPLLLIDDTVDKTNLFEAIAEAKLAKMNYIRQKFLYERHIISKSILDKTKAVLLSRIAKIIQYKNIINEKKIRAPFSGKIGIFNVHVGQYIAYGDIITYLKSIGPTYVSFQIKENNISHIYIGQKIIITMTAYPNTIFKGKITAIDTLLSNNIKSIKVQGIINNPLKKDLLPGMSGNIKIILSTKNKVIAIPQESIVYTLYGNFVYTVSEKKDHKNNKIKTYAKRTYIKLGEQRENLIAVTGIKKGERIIIDGQTKLHDGSLVRIVTDSVNNKSKKNKFLN

SEQ ID NO: 279 - protein, 1015 aa, Candidatus Endoecteinascidia frumentensis
MKNFTKIFIKRPVLSSVVSLLILILGVSSIFKLPLRQYPKINSTTIVISTLYPGANAQIVQGFVTIPLERSIASSDGIDYIESSSILGLSNITVHIKVNYNIENVLNDISGKINIILSQLPKSSSKPSIIKSNMNIMPNIILSFNNKNMSPEEITTYLNNFIIPDIYSVGGVSQASIFGEKKYSMRIWLDANKMQQLGVTPIEVYNSLLKNNISTTAGQLKSKYMYIDINIDTYIKSVKDFNNMIIKDYHGHLVRMKDIGKAVLGPQSYRTKVFYSGKESIFIGISSASNSNPISVIKKIKYKISFWKSHFPPGMQVNIVYDGTKYIHTSIYDVIYTIIESSIIVAIVIFLFLGSFQSVFIPMITVPLSLIGVCSFIFFMGFSINLLTLLAMVLAIGLVVDDSIVVLENAHRHIKKSNLSPINATIKASREITNPIIIMTTTLIAVFAPIGFISDITGSLFREFAFTLAGAVLISGILSLVLSPMMCSKIISKKTFQNKLVQFIENILSKIRNFYEKMLNLVLNYRFTTAIMGCLIFISCYFLFIGTTKEFVPIEDQGYIGIIGIGPSWANLNYLTKYNSQIEKIFHTFPEVKDTFSIDGIIPDSHSIFSAMILKSWNKREKSQMIIASHVNQELQKITGLQAVAIQFPSLPGIPYGPGVQIVLKTASDYKKLYMLSENFIKHIMKNDMFIYANNSLKFDKPLLNIHIFRDKTNMLGISMQDIALAMSVMIGNNAYNYFNIQGNTFEVIPQVFPDFRKNPNALKNIYISTQFGKLIPIYDLVSMKYTSQPSSLTHFNLLNSTTIQLAMNYGIKIEDAVKYIKKEAKKILPSDITYNFIGSARKYLHEGNTLLYTFIFSMIIIYLLLSAQFESFRDPFIILVSVPMSICGALMPLYLGFATINIYTEIGLITLIGLISKHGILMIDFANTLQKKGGYSIYKSIKTAAKIRFRPIFMTTLAMIFGVIPLIHSSGAGSISRYNIGLVIFFGISVGTFFTLFIVPVTYTFLAKKHNKEI

SEQ ID NO: 280 - protein, 306 aa, Candidatus Endoecteinascidia frumentensis
LSHKPVLLKEVLNILEIKKNGIYIDGTFGCGGHSKGILKKLGEKGKLHIFDKDMESILLAKKLQLKDPRIIVHHDSFSQIYKLEKYQKKIDGILLDLGVSSLQINSANRGFSFLKSGPLDMRMNISSGETAENLLKKIKKKKLIKILKKYGEEYKAKYIAHEILEERKKNPIQTTLQLSNIIKKSTFNKYNHKHPARKTFQALRIYINQEIKELNSCIKYIPKLLKSGGIFIVISFHSLEDRIIKTQFKNWINLTNDYPVKLPVKEEIIEKKKYFKWKIKRIKPSNIEININRRSRSAILRAIKKI

SEQ ID NO: 281 - protein, 150 aa, Candidatus Endoecteinascidia frumentensis
MLLSKKEYEIFKLLNPTIKGLGYILWGIKLFHKKKKLFLIVFIDHKNNISINDCENVSNQISYLLDIENIIQKYYILEVSSPGINRFLFFPFQCQFYYNKKIKIWMYSDTDKNIIIGFLKKMYQDSILIKKKKEERILFFHSIKKIQVIL

SEQ ID NO: 282 - protein, 497 aa, Candidatus Endoecteinascidia frumentensis
MGKELLLVIEAVSNEKNIDQESLFQGIENAIEMATKKHYNKNWNIRVNIDRKTGKYNTFRCYTVIEDNKVLDDMESYIYISEAKKEYPNIKISEIIAEQIQSVDFGRISTQIAKQIIIQKVREAERNRIAKQYKWKIGKLLHGTVKRITRENIFLDLGESVEGIMPKNEILPGEFFRTNDKVKSCLKELYKDKKGSKLILSRISPEMLIQLFYIEVPEIAEEIIEIKSAVRDPGQRSKISVKTNDGRIDPVGACVGIRGSRVQSVSNELGGERIDIVLWDSNIAKYAINAMSPAEVQSIIIDEDKKNMEIVVEEKQLSQAIGKNGQNVKLASQLINWNLIVTTNLESQKKKEKESQYSINLFSHSLGIEKKIAHIIVDSGITTLEELAYVSLEEVNKLNILDKNIFQKLQEKANTLLLSQALKIDKKKPSNDLLFMEGMDMETAKLLVEKGILSRENLAEQSVDDLLDIGINHSRAAKLIMTARAPWFSEKKIPCKK

SEQ ID NO: 283 - protein, 816 aa, Candidatus Endoecteinascidia frumentensis
MPNITVQELAKNIGITEENLLRKLCQAGLPQKNSLDFISDIQRKVLLGFIRGTNIKKKITLQSRNISKIKIIGQTLKTINIEVRKKKICTTDIEKIKDSNIEYQNHNNLSIKNLDKSYHKEYKNNTKILNTVSLQKENIQKKKEKIDQLNSKNFKIEKKNKDLNMIERKKKGLIKSQIKNSSKVDLLKVLDTIQEDEKEDTDIYQNKKNFFSRKKIKNIEKKNSNFFKKHILKVKIPEKISIENLAKKIFVKKKNLKKKMLELDLINSEYTKHINQEIAALIVEYMGHEPILINNDFLEKELLHQKKIKKGKKISRPPIVTIMGHVDHGKTTLLDSIRNSNIVNNEFGNITQHIGIYPIKNKKGIITFLDTPGHEAFSVLRQHSANIADIIILLIAADDGVMPQTIESIKYIQSLKKPIIIAINKIDKEGVNFKNIKNNLLKYNIIPEEYGGEHICINISAKKKIGIDELIESIFLQAEMMDITSTMNIPAQGIVIESKIDKRIGNITSLIVKNGILKKGDLLVCDTQISRIRLMMDKFGKIIQKAYPSIPVDILGFSKPISSGINFYVLKNEKKAREITNYYKNKKNIQTKNINTNQKKYSNLFDKLSHIQNEKHISIIIKADRQGSIEVISNALLHLSSNKKNPTLIKIISKGIGDIKESDVNLAKASNAIILGFHVNANVLAKQIAKIYKIKLYFYKIIYNLIDDISKLIFHMISPKKYNNIIGSAEVKNVFQFQKNGIVIGCIVIKGIIKKNSLLQIFRDEKMIYKGKLESLRYFKNDVNEVKEGHECGIRFKDYNNIQVGDKINIYDIIKN

SEQ ID NO: 284 - protein, 115 aa, Candidatus Endoecteinascidia frumentensis
MFNINRIRKIENLFFMILSESFIKKIKDPRLNLIQITDVVLSKDLSYAKIYFNCIKYDTSIKIVEKTLKKSTGFIRMLLARNTKLKYIPQLHFIYDNIPYKAYNLSLLIDKALEK

SEQ ID NO: 285 - protein, 251 aa, Candidatus Endoecteinascidia frumentensis
MLVLCFGSATKLTQYILEDDKSYSAILKLGEETSTGDKEGNIISTLPIPKKLNLKKILYLEKKFTGIQYQKPPMYSALKYHGIPLYKYARKGITIFKPKRKIIIKSLKIYSYSCYPNKIIFHTICSKGTYIRILAEDLAKELGTVGHLIALHRNYYSRFKSYKMHTLENLNNKNFLDKLIPMDSGILKWVIYNANINEWKMLYYGINFTLSKNINGWIRIYFKKKLVAISYMQNGNFIKKKILCSSHFIRI

SEQ ID NO: 286 - protein, 221 aa, Candidatus Endoecteinascidia frumentensis
MDILYKKKLEKYLRIRNIFLTNYQKNQCIEFLYLLFKWNKRCNLTAVKNISDAILLHLIDSLSIISHIKNVKNILDIGSGCGLPSIPLAIVKPNYFFELTDKNKKKYHFLKQIKIELQLSNIQIYYGNIQNYNTQNNMNIDVITSRACFNILNLTKYCYHIFHKNIKILIMQKKIKFNDIKKIKNNGYKVNIYYMPSIFGIERNLIELKIKKLNSYKMRRT

SEQ ID NO: 287 - protein, 1220 aa, Candidatus Endoecteinascidia frumentensis
MNTLFELLKKKILILDGGMGTMIQKYCLDEKMYRGKLFKDHTFSQKGNNDLLNLTQPKIIQKIHQDFLNSGSDIITTNTFNSNRVSMADYGMENYIYQLNFQGAKIAQKAVHIASKKNSKKIYFIAGSIGPTNRTATISPDINRPDFRNINFKKLVKIYTESIHGLIQGGVNILLIETIFDTLNAKAAIYSIKKYFYKYNIVLPIMVSGTIIDASGRTLSGQTPEAFWYSIKHAKPISFGFNCSLGSKDLKPYISDIASFVNTYISIYPNAGLPNELGEYEHTPKYMAKILKNFAESQLVNIVGGCCGTTPKHIQYISSELFDVLPRKLPKNKFYTCLSNLDPLIIHPKKNFINIGERTNVNGSLYFAKLMKNKKYEEAIEIARDQVNSGAQILDINMDDGMIDSELEMSVFLNFIASEPDISKIPIMLDSSKWSVLEIGLQHLQGKGVVNSISLKEGEKIFIQHAKKILQYGAAVVVMAFDEKGQAESEKRKIDICCRAYLLLRNILNFPSEDIIFDPNIFAVATGISKHRKYGIDFLKAIKKIKNFCPYTKICGGISNFSFSFRGNNLVRKSMHSVFLYHAIKEGMDMGILNSKEIGLYEDIDLTLRNTIEDVLFNKYPNASENLLKIAENFQLKKEKYKEKDITWRKKPIQKILDYSLIRGIDKYIENDIEFLRKNMKKAIYVIEGPLMNAMNKVGDLFGSGKMFLPQVVKSARVMKKAVSYLIPFIKNENISNFRKGKILIATVKGDVHDIGKNIVSVVLQCNNYEVIDLGVMVPCEKILDAALKYKVDIIGLSGLITPSLDEMVYVASEMQRLNIKIPLLIGGATTSKLHTAIKIFPKFNLDQVIYVPDASKSIGVVNLLLNKDKKYNFINSIKLEYKQLQKRYINQKKNILFVPISFARKNIFYINWKKYIPPVPKFLGIHTFQNYSLYKLVKYIDWTPFFQVWELKGSFPKILQDKKIGKEAQKVYKDANILLKKLILEKIIVAKGLLGLYPANSVGDDIKVFSNEKRNKIIATFYNFRQQSKRIKEIYTSLSDFIAPKKFQIPDYIGAFIVTAGINSDLIISKYQKKYDEYNSIMIKALTDRLAEAFSEHLHELVRKKYWGYSPMEKLDINLLLKCKYCGIRPAHGYPSCPDHTEKKTLFKLLNAEKNIEVKLTENCAMIPSASVSGLYFSHPESHYFGLGKIHMDQLKDYAIRKGISLDIAKKWMLSHLYY

SEQ ID NO: 288 - protein, 220 aa, Candidatus Endoecteinascidia frumentensis
  MISC_FEATURE: EtuM3 (EtuA2 substrate formation; methylation)
MKKYLILNDIAYNFLLKTGIREHSILRKLRIETQKKFSKNNMQISPDQGQFLQWLVRLTKSEFIIEIGCFTGYASLAMSLAMSKNGKLFTCDTNIKWTCIAQYFWKKAKKNHKIFLYLEPAITFLKKMLMDDNIRRKVDLLFIDADKKNYPIYYEMALKIVRFGGIIIIDNVIGLKDLHINNSKDSAKTILQLNKKIHKDYRVDISMIYIGGGMTLCRVL

SEQ ID NO: 289 - protein, 183 aa, Candidatus Endoecteinascidia frumentensis
  MISC_FEATURE: EtuY (Carbonic anhydrase/acetyltransferase)
MSNDIFIRPFKKIYPKIGKRVYIDPKSLVIGNVVLNNDVSIWPFVSIRGDLMQINIGESSNIQDGSILHTTHSSIFNEKGYPIIIGKNVTIGHKVMLHGCTVEEETLIGMNSVILDGAIIQKNAIIGAGSLVSQNKIIKGGYLWVGNPVKKIRILTKKEISFFRYSALHYVSLKNQYLKEIKL

SEQ ID NO: 290 - protein, 181 aa, Candidatus Endoecteinascidia frumentensis
  MISC_FEATURE: EtuO3 (Flavoprotein)
MNPHILVGMSGGIACYKTVSVVRLLKKKNAKVNVIMTKNAKKFITPLTMQSISNNIVRFNTFTKHHNKNDYMEHIKLAKWAQHILLAPATANIIAKLTYGFADNLLTTICLATKAPISIVPSMNQIMWLNISTQTNIKILKNRGIDIIGPELGEQACGDFGYGCMTNPKDIVRIVMRKFLL

SEQ ID NO: 291 - protein, 218 aa, Candidatus Endoecteinascidia frumentensis
  MISC_FEATURE: EtuO4 (Flavoprotein)
MNLTYLITAGPTQESIDPIRYLTNHSSGKMGYALAKAAAKNNSFVILVTGPTQLKIPNNVECHKSITAKDMNTIVMREYIRADIFIGVAAVSDYTPKITYRNKLKKSHNSIILTLEPAVDIIKNVSSLKEPPFLVGFCAETHNIENFAKEKLRKKKLDLIVANDVSRSDIGFNVDYNSIVVYFNKGKKKFHKASKNKIAEKLIQFIEKHYDKKYNHRI

SEQ ID NO: 292 - protein, 154 aa, Candidatus Endoecteinascidia frumentensis
MIKNTTIEFKVLDKKIGKKIPLPKEGTIGSAGLDLRVCLNKPKKIYPGKTILIPTGIAIYLNDPNIAGLILPRSGLGHKHGIVLGNLVGLIDSDYQGEIMISCWNRGEKIFFINPGYRIAQLIIVPIIKIKFKKVEKFSLSKRGIGGFGHTGLI

SEQ ID NO: 293 - protein, 55 aa, Candidatus Endoecteinascidia frumentensis
MFNKFVKWICKKKIYISDTDKFLIFLDKKYPKLSSSQKEEINKYKDIFNSKNYLK

SEQ ID NO: 294 - protein, 366 aa, Candidatus Endoecteinascidia frumentensis
MSNFNQNIKKNNTKNFQKTGLEEIVMGADRIQVDDKKIINCRADLNQLFPLKYNWAWQKYLDSCANHWMPQEISMVSDLALWKNPYGLTKDEKIILKRALGFFSTADSLVANNLVLSVYRNITNPECRQYILRQSFEEALHTHSYTYIIESLGLDESELFNMYREIPSIHDKAAWSLKYTKAISDPAFKTGTFETDLQLLRDLIAFYVVFEGIFFYVGFVQILSFGRRNKMKGTSEQIQYILRDESMHLNFGIDLINQIKKENPDLWNKNFKEEVREMLHEATILEKRYAEDTMPRGILGLNSKIFHEYMQFIANRRCLQIGVDKLYTDSENPFPWMSELIDLKKEKNFFETRVTEYQTGGTLSWE

SEQ ID NO: 295 - protein, 920 aa, Candidatus Endoecteinascidia frumentensis
MNDIKIKKNIKVIKRNGNIVSYNKNKVKTAIEKAFFAVEGIQDCNKSSRLKRIIYNFFQEKHGFLTKKKNPIHIEDIQDQIELYLMQKGEYKVVRAYVLYREKRRIIRKKHFKENDYKLEVILDKNKENSLEFYRLKNICYKACTELKDLNYKAILKETKRNLFNGASNKEIRKAFIMATRTLIETEPNYTYIAARLLLDELQTETFKFLKIKEKNYQEIQKLYPKIFILFIHKGIELERLSMDLLKFDLKKLGYSLKYKNDLQFTYLSLQILYDRYFIHENNIRYELPQIFFMRVAMGLSIKEDNPTDRAIEFYNLLSSFNYMTSTPTLFNSGTLRPQLSSCYLSTISDDLFNIFSSMRDNALLQKFSGGIGNDWSYIRGMNSSIKGTNGKSQGIVPFLKISNDIALAVNQGGKRKGAVCAYLEIWHIDIEEFLELRKNSGDDRLRTHDMNTANWIPDLFMKRVLEDKYWTLFSPNEVQELHDLYGIAFEKAYIKYENMAKNLNIILFKKIKAIKLWRKMLAMLFETGHPWLTFKDSCNLRSPQQHCGVIHSSNLCTEITLNTSYEEIAVCNLGSINLVKHITHNGDIDLLKLKKTIYTAVRMLDNVIDINYYPVPQAKNSNLKHRPIGLGIMGFQDVLYMKGIPYESQYAIEFSDISMEIISYFAISASSDLALERGTYQTFKGSLWNKGILPIDSIKNLEKNRGKFYTKINKNQTLDWNLVRKKIKKNGMRNSNIMAIAPTATISNIVGVSQSIEPTYKNLFVKSNLSGEFTSLNPYLIQDLKKHKIWDTNMVNDLKYFNGSIQEIKRIPSNLKRIYLTAFQIDQSWLIECASRRQKWIDQAQSLNLYLSTPSGKILDKLYKLAWIKGLKTTYYLRSLSASNTEKFTIQKDNSLNSVESSNNPKACSVQDFDCETCQ

SEQ ID NO: 296 - protein, 198 aa, Candidatus Endoecteinascidia frumentensis
MPFKLLHLPYKKNSLEPYISSETINFHYEKHHKTYVENLNKLIHNTSYNNQSLEKIIISSKNAIFNNAAQVWNHNFYWNCLTEPHISKKSYINNNKFIQKISDNFESFNKFKEEFSMQALGNFGSGWTWLVKTKNNQLEIFNTKNADTPIMHNKIPLMTIDIWEHAYYIDYRNVRLQYIKSFWQIINWNFISNNYANH

SEQ ID NO: 297 - protein, 105 aa, Candidatus Endoecteinascidia frumentensis
MESIEKKIQNQINKNPILLYMKGNPEFPQCGFSAKVVKILQNCKKQFQFINVLEEPEIRKVLPKFSNWPTFPQLWVNGNLIGGCDIISEMFDEGELQTLLESIRS

SEQ ID NO: 298 - protein, 1044 aa, Candidatus Endoecteinascidia frumentensis
MLFKDFLLKSETILEKKISDSHYLDEKQCILNLISHAEFEENINKKITNYAKQLIIHARNNKKKIGNIDIFLTEYNLSNEEGIALMCLAEALLRIPDKETSDRFIKDKICKANWKNHINQSDSIFINAATWGLLITGKIIKPSYKKNLSGIFKNFLIRTSKGSIRLIIRQAMKILSRQFVLGEDIQESLEKSQEEKSKGYYYSYDMLGESAKTEKDSELYYQNYLNTIDIVGKNSKNINDIYQKPNISIKLSALFSRYEFSQLQRVMKELYSRVKHLAMRSKKYNITLTIDAEEASQLEISLQIIEKLALDKDLINWNGLGLAVQSYQKRAYSVIDWLINLSHRSNKRLIVRLVKGAYWDSEIKIAQTGGFENYPVFTRKSYTDISYIACAKKMLFYKKEIFSQFATHNAYTIASILEFSDGVDFEFQCLHGMGSGLYDQIVQSNNKIPCRIYAPFGNHKHLLAYLVRRLLENGANTSFIYRIRDKKISPEKLIENPIIIAKKFDGEPHPNIPLPKNIYKTRINAKGIDINNRIIMKKLIKKINFATKRWESYPLIAKINKPNRYEKYVLNPENSKEIIGTIIYTDPNEVDIAIERSLIAFSKWKKVSVIDRIYYLQKMGNLLENNMENFIALLIKEAGKTIPNAISEIREAINFCRYYAEEAKKLFSSPIEMIGPTGEKNSLYYHGRGIIACISPWNFPLAIFLGGIVASIVAGNTVIAKPAEQTSLIAHKTVQLLYKSGIPKDVVQCLPGDGNIIGEKIINDVRINSVIFTGSNDTAKRIFRLISKKSGIITNLIAETGGQNALIVDSSALLEQVTTDIIYSAFNNSGQRCSSLRVLFVQNDIADNLISMIKGAMKELTIGDPKYLSTDIGPIIDQESKKKLLDYISYIKLYADMIYQVDIKNNTNINGNFFPPTIIEINNINLLKEEIFGPILHIIRFNSYDLKKIINQINNMGYGLTAGVHTRVNDTAKYICDNLNIGNIYINRNQIGAEVGVQPFGGEGLSGTGPKTGGPNYLVRLSYERTISINTTATGGNTVLLSLE

SEQ ID NO: 299 - protein, 258 aa, Candidatus Endoecteinascidia frumentensis
MPKKIRIKHHIKMGRRKGIFLLPNIFTTISLFFGFFSIIYSIGLQFFISSISILIAFIFDSLDGRVARIIKVQSDFGAEYDSLSDMIAFGLAPSLMVYNFSIQILENIDWKRFSWLSSFIYIACVALRLAKFNTRIKLNSALAKRYFFGMPCPASAIFLSSMIWLCNFYNFNNYLIFFLSEILIIIFGLLMVSNIRYRSYKDIDIRSPVKSKILVAIILIIGLIAFQPIWTVFILSGLYITSGPIYKIKFFLQQKKKK

SEQ ID NO: 300 - protein, 174 aa, Candidatus Endoecteinascidia frumentensis
MKNKKHIWNTSQKKILKSLNLDYLIFQNHIDKQYIKKIKINYNILEELHNYDIILATQNITIDSDIYYLLNNIKYFLSLYKFTICIVKQVNETSKNFFTINKIVKKINPKWIICFGKKIYEDFLEKIDKKFLIKTLELKELLIDPLKKKQVFWDVRHITIQKIYNRRFIKNNEN

SEQ ID NO: 301 - protein, 521 aa, Candidatus Endoecteinascidia frumentensis
VINEIKKRKTFAIISHPDAGKTTITEKILLFGGAIQLAGSIKARKSQKTTTSDWMEIEKNRGISITTSVMQFPFKEKIINLLDTPGHEDFSEDTYRTLSAVDSALMIIDAAKGVENRTIKLMKVCRMKNIPIITFINKFDKNSKNPIELLDEIEKFLNIQCFPVIWPIGMGREFKGIYHILKDKTILFKSGYKNYIYYFQSIYGINNTEFKKIFNFFDLLEEEIILIKKLYTFSKSKFLSGMITPIYFGSALCNFGIKELLEDFIKISPSPMYRNAYTRKVYPEEKNFSGFIFKIQANMNPKHHDRIAFLRICSGTYKKGMKIKHVRTGKYINISNALTFMAKKRINNEYSYAGDIIGIHNHGTIKIGDTFTEQEDLKFTGIPNFSPEIFRRIILKNPLKIKSLNKGLLQLSEEGAIQVFRPIINNHIIIGAIGTLQFDVVIQRLKDEYKIKCVYKNISITHARWIKCIDSKYLEYFKKKYLSYLSYDSGNYLTYLAPSFTNLKLIQERYPNILFSNVREN

SEQ ID NO: 302 - protein, 218 aa, Candidatus Endoecteinascidia frumentensis
MRIILLGPPGSGKGTQAKNLSQSLKIPIISVGDILRISQNKKTIPIYELNNAILHGKLISDSIIIKLVRMYIQKSKYQKGFILDGFPRTLEQAKATKNFNIDYVISLIVDNKTIINRISGRRIHLPSGRIYHIFNNPPKNLNRDDITGELLTQRQDDNEKIIKNRLLIYKKKTQPLIFYYTNKNIKNKNPKYIEISGIGLEKSITANILKNIYTHKKY

SEQ ID NO: 303 - protein, 328 aa, Candidatus Endoecteinascidia frumentensis
MHLYKVRNLIFQDIEKLDKWMKFFLKNSIPLINDVCHYTIYNGGKKIRSILCLLSAKSIFCNSNVAIILAMIIEIVHTATLLHDDVIDSSKIRRGKKTVNTLWNNTTAILSGDYLYSKALLLMSNLDDKIAMKKLIQCTQKLAEGEIMQMYANFNINIEEKEYLKIINYKTAILFEMACSLPAIILKKNFQTIQIFKLLGHHIGMAFQLINDIIDYKNINDRIRKKSYEDLYEGKMTLPIIHIMQKRNNIKNIEKIYQVFDKSLKNRKNLFQDIHNLVINSGSIEYVKNCIQNEINLAKLYIKKLPYSSYKKGLFMICDSLIKKGIKN

SEQ ID NO: 304 - protein, 271 aa, Candidatus Endoecteinascidia frumentensis
MSKIVVVTSGKGGVGKTTTSAAFGTALSINGYRTVIIDFDVGLRNLDLIMGCERRVIFDFVNVINEDVHLNQALIKDKYTDKLYILPASQTRDKEALHIQGVGKVLEELSQNFDYIICDSPAGIERGAFLAMYYADEAIVVANPEVSSVRDSDRMLGLLSSKSQKSKNQKNKMKEHLILTRYSPKRVKKGDMLSIKDVQEILNISLIGVIPESTDILKASNLGKPITLNKKSYAGQAYLDAADRFLGIKKPYRFIKSENFFTRLLRRKIFR

SEQ ID NO: 305 - protein, 101 aa, Candidatus Endoecteinascidia frumentensis
MKLLNLIFSYLKNNTKNISTANIAKERLKIIFSHEKSKKNNSDFLIKMQKEIMQVIFKYTKVQSDQIKIDFGKKGDCSILELNIIVPENIENSFKETKKLI

SEQ ID NO: 306 - protein, 108 aa, Candidatus Endoecteinascidia frumentensis
MKKYNLKKNTTDIYELVIYQLNPIKKRKEWKIIHKNLTDKLFLIPGCLRIDTYKLLSSNNIFCDYVYWDSIKNAYIGKKKFKSFIGFDKMMFYIKKILFSGIFYKSND

SEQ ID NO: 307 - protein, 275 aa, Candidatus Endoecteinascidia frumentensis
MSTYIIGDIHGCFKTFKILLKKINFNPNQDILWLLGDLVNRGPYSLEIMCWILNHQNNIQAVLGNHDIYAIACYFHRKNKKNNDTIDDLLDSPKINDIIYWMRQQPVIFFDKKIHSLIVHAGFNPNWSLDQIFLYANYIEMILKSDLIFDYTREFHNIQKKKLNGYLNPYEKWYFYLNYFTKIRICNKFGTLNLRFNGNLKNIPKKFLPWFCYNFVNINRKIKIYFGHWAALEGVTNVRNIYNLDHGCVWGGKLTAFCVEKKTYISVQSVEFKKK

SEQ ID NO: 308 - protein, 150 aa, Candidatus Endoecteinascidia frumentensis
LKNNIINSYCLDAFSGSGSLGLESLSRNAKHVTFIEYNKEIFQHLKKNILQFPISPSSVRLYHIKTEIWLKLYKNQKFDIIFLDPPFYTKLIFQCLYLINIYNNLKPHGLIYIECKKTTKLKKYIMNNWNILKKKETKRLQIYLIKKKYL

SEQ ID NO: 309 - protein, 75 aa, Candidatus Endoecteinascidia frumentensis
MALNVEKKSSIIKEYQLKDKDTGSTGVQIAILTARIKDISSHLNKHKQDKHSRHGLLKIVSKRRKLIKYLKKISK

SEQ ID NO: 310 - protein, 710 aa, Candidatus Endoecteinascidia frumentensis
MKIIKQIFEFGDDKYILETGGIARKATSSVIVRVKETVILVTLVAKKEISSDINFFPLNVYYQEKMYAGGIIPGGFLKREGRPTDHEILISRLIDRPIRPLFPKDFFHEIQIVATVLSSDPKIISDIPAMIGASAVCSLSGVPFLGPIGCARIGYINKKYVLNPNYKELEDSSLNLIVSGNKDSILMTEAESNQLSEEIILESIMHGHEQLQVVIQAINELVEVCGNPKWNWNPNLVDTKLVKKIKNIVKSHILDLYQIYEKNKRNIQITEIKNQFYQEYLKNIEIEGKEKKISELTIMNIFNQIESKYIRKKILNGGLRIDGRKNKTIRSIHIENGILPRVHGSSIFSRGETQAIVATTLGHERNAQIIDAMVGESKNRFLLHYNFPPYCVGEVGIIGVPKRREIGHANIAKRAFKFVFPNEKEFPYVIRVVSEITESDGSSSMATVCGASLSMMNAGIPIKSHVAGIAMGLIKQDNKFAILSDILGEEDYIGDMDFKVAGTELGITALQMDIKIPEGINKNIIYSALVQAKEGRIHILKLMNQVIKKSINLSRYAPRIYKMKVSTEKVREIIGKGGSTVRSITEETGANIDINDVGIVNIFSFNKIGAEKAINRIKEILMEPKIGKEYEGKISRVEDFGVFVTILPGKDGLLHISKIQDYNIDYKSYFLIGKKIFVRISSIDKKGRIKLTMNKKEIKRKKKKLEKKKI

SEQ ID NO: 311 - protein, 248 aa, Candidatus Endoecteinascidia frumentensis
MAWNHKKSIFATMISSALWIGSASVYANPIHENTKYNEDQNLAEKSEKNQEIFPKTFLHKNNQENKYLGISVGYSKFISRDGKIENFVENHIPVGIFAGLKLNNFLKIEVRAERIGAFQNYNNDRDKTFRNSATFYNGSIDGIVSVPISSNSTNNSYLEMFNYSNFNIYAKAGYGINFSNYSFPVSSGTNPKSVKQAGFNAGAGINIDWNDGISTRIGYTYYQIPETGNMQAHGNMHVISADIYYNIV

SEQ ID NO: 312 - protein, 419 aa, Candidatus Endoecteinascidia frumentensis
MEKKIKKNINSFYSWLVFFISSSFFLYKYLLQISPTVMTNELLHDLHLSGFNLGNIIGIYFYIYLIMQIPAGLLIDRYSPKWIMTISILICTIGMFIFSKAYSLFYIEVGRLLIGLGGSSAVVGTMKLISIWFSKNKFALISGIMMAFGMVGAITAEGPLSYMIKIYGWRKSSFFLSLIGLIIFVLFILIIKENFQKKKLLSKEQSNSYIVKGFIKILLNKESWLISCYSGFAFVPISVFGGFWSIPYLMHVYHINRVYIASLNSIIFIGFLISAPLGGWLSDYFQNRKNIMIVGTSMSFIFLSLIIYMFLPIWVLIFCLFFLGFFNGFFLVSFTMIKESNPIYLSATSIGFINMFNALCGAISGSMIGKLLDLSWNHIINNHTRIFLIHDYKIALSILPVFLLLGIICIFLSKETYQT

SEQ ID NO: 313 - protein, 445 aa, Candidatus Endoecteinascidia frumentensis
MFQTLSNKILHIFNKIRGYGRLSESDINKTIKNIRIAFLEADVSLEVINHFIYKFKKRAMGSEVGRSLSPSQTIIKIVKQELVSIMQKKNLDSKINLNTQPPAVIVLAGLQGSGKTTSVIKIAKLYKFFYKKKVLVASIDIYRPAAISQLCILSKDAEVDFFYHHESIKNDPIKIAKSALVYSKKKFFDILIVDTAGRSHININMMKEMILLKKNLNPIEILLTIDCMMGQDAINIAKSFDDYLKITGFFLTKSDSDAKGGSALSIQYITGKPIKFIGTGEKNSDIEKFEPEKIANSILGMNDILKNIKDIEAKFYDSNNIKIKKIENKKKFDLIDFNHQLKMLNKIGNIDTLTKNVSQLRNFSISNKKIIDNNLIKKMQFMIDSMTVKEKKNPNIIKSSRKKRITSGSGTTIQDINKMLKYFIVIKKNLKKYGKKKKNFNFLNN

SEQ ID NO: 314 - protein, 90 aa, Candidatus Endoecteinascidia frumentensis
MVVIRLARRGSKNRPFYQIVVTDKRAPRDGRFIEIVGFLNPLLLKENKNYMFLNIKSINKWIKNGAQLSDTVERLFNKIKKKSIKRNSIN

SEQ ID NO: 315 - protein, 194 aa, Candidatus Endoecteinascidia frumentensis
LASSSSPRKKILNHLGIPFISISPNINEKPFPMEKISNLVQRLSKEKVIAVSSMIPKNKPFIILGCDQMAIIDKEIIGKPYSYNQAFIQLKKIRGKCVKFYCGICVFINTENYMKTSIEKTEVFFRKFSIKEIELYLKQEKPYKCAGSFKSEGRGILLVNKILGKDPNSLIGLPVLLLQKILLKKKINLLNFFL

SEQ ID NO: 316 - protein, 418 aa, Candidatus Endoecteinascidia frumentensis
MKTKKYLLNTKKEIPKDTKIISHQLMIRSGMIQKLASGLYSWLPTGVKVLKKIKNLIQKEMDFFGALEVIMPCIIPAYLWKKTKRWEKFGNELLKIKDRKGHNFCFGPTHEEVITDLAKYSIKSYKELPIHFYQIQTKFRDEMRPCFGLIRSREFLMKDSYSFHLNKYCLQKTYKNMRDLYYQIFKKLGLFIKIINADSGIIGGEINQEFHAFTDNTKVDINYISDKKNNLISKDIQNFKKNSINNKNIFNYSNSIEVGHIFQLGEKYTKNLNLSILNQQGNFIYPFMGCYGLGISRTICAIIENNHDKNGIIWPEKIAPFYIAIIPIKYYESKIVYNYANILYKNLISFGFDVLLDNRREQTIVMLKDIDLIGIPHCIVLNEKKIQNKKVEYKFRKTGKIIDIEFNNLINYFKKNIQ

SEQ ID NO: 317 - protein, 588 aa, Candidatus Endoecteinascidia frumentensis
MRKYCTNITELYIGKKIELQGWVHKIRNHGGLIFIDLRDISGLIQIIFQPENKQIFQKVLKLKNEYIIKIIGLVKKRPVKKENIKSFTGKLEIIASKLVILAKSFPLPFPVNKYQDLNEDIRFTYRYIDLRRFESQKYILLRSKVTNILRSFLEKKKFIDIETPILTKSSPEGARDYIVPSRIHKKCYFALPQSPQLFKQLLMISGFDKYYQIAKCFRDEDLRANRQPEFTQLDIEMSFIQEKDIINFSEKLIKFVFKKVMDIDFKDKFPCISYKESLLKYGTDKPDIRIPLVFHEIKELFQYENHRYIKKYFRDKNSRIVALKIPNGNKIISRKVFKFYKNFVLEKGSENLSYIKVLSIKKSSEFNIKSSLDKIISNTTIKNILQKIKTKVNDFIFLIADKEDIVNTCFNALRRKIGKDFNLYSSQWAPIWIINFPMFKKNKINLESVHHPFTSPSIDNIEDLNKIPLEKILSRSYDIVINGSEIGSGSIRINCPNMQKAVFHLLGMNNKEIEQNFGFFINALKFGAPPHGGIGIGLDRFIMLLSKTNNIRDVIPFPKTQNSSCFLTKAPSFISKNHLNELSIFYKK

SEQ ID NO: 318 - protein, 242 aa, Candidatus Endoecteinascidia frumentensis
MSGHSKWSNIKYKKSKEDNRKSRIFNRLIREIYIAGQDQKKENSKNIANFKLKKAIQNAYAANMPKNTIDRAIKKINEKNLQKFENIRYEGYVLFGVACIIDTITNNRNRTVSKIREIFKKYGGNLGRSGSVSYLFLEKGILSFHTKNNEDRILEIAIKVKAEDINIKKNGFIDIITTPNKLISILKKIKIEKIYPYKNKIIPVAISKIMLDKNKNKEFSLFMNDLKNIEDVQNIYTNAKII

SEQ ID NO: 319 - protein, 902 aa, Candidatus Endoecteinascidia frumentensis
MFQNFQKKSKINIYTEYKKRLSIFSLKKLDNLLDGKIQKLPYSIRVLIINLLRNIGNYNISENDLINTINWKAKSYIRKDIPYMPNRIIMQDFTGIPAVVDLAAMRDVLYKYGGNPKDINPIINTTLVIDHSIQVDYYNTSKALEKNINLEFKRNHERYSLLKWGQKNLDNFKVVPPGMGIIHQINLEYLTKIIEIKKINSEFFAYPDTLIGTDSHTTMINSLGVIGWGVGGIEAEAAMLGQPCYINLPDVIGVKILGKAKENITSADLALNITEILRKYNVVGKFIEFFGNDLSHISLSDRATISNMAPEYGATIAFFPVDIETINFLIESNRGKYIKIIKKVLQESLLFRLNDIYHPEYSDIIEIDISKINASISGPKRPQDRISIKKLKNSFKKSLIALKDENGFEINKNDLDKNVFVPEINDFIAHGTIVIAAITSCTNTSNPYSMIGAGLIAKNAVKRGLKIKSFIKTSLAPGSKVVTEYLESSGLLKYMNILGFNIVGYGCTTCIGNSGPLFKPIIDVSIKNNLVLCSVLSGNRNFEGRINLYVKANYLTSPLYVIAYAIAGTINIDLNLDPLGRDMQGKMVYLKDIFPKEIEIKKIIKKFINSNIFKNQYDKIFSGTENWKSLKYPKGDRYIWNKKSSYIRSPNFFSMSLNKTSQDIINARVLLLLGDSVTTDHISPAGAIPSQYPSGRYLKNLNIPENEFNSYGSRRGNHEVMVRGTFSNIRLQNLLIPKIEGGFTKHYPSEKIMYVFDAAMSYKKDNIPLIIISGKEYGVGSSRDWAAKGTSLLGIRAIIAESYERIHRNNLVGMGILPLQFMKGEGRKYLDLNGSEIFNIYGLSSIFPLKKIQIQYYYAHKKKKIYSFYAFIRLDTNIEIQYFYSGGILPYILKNNLKKNQN

SEQ ID NO: 320 - protein, 358 aa, Candidatus Endoecteinascidia frumentensis
MKKSIKERLKILIERYEELCHLLSDIKIINKKNMFRKYSKEYSRLEPIVMCFNDYCKEESYLDSLKEILKDKDPEIRKMAKQEFQDVYRKIQNNLKKIEIFLLPQKENYQKNIFLEIRAGTGGKESCIFAGDLFRMYRKYSENHNWKLIIINQNFGEHGGYKEIIAKIYGENVYTNLQFESGIHRVQRIPLTESQGRIHTSACTVAILKEVPKSEEIKFTNNDLRIDTFRSSGAGGQHVNKTDSAIRITHLQTGIVVECQDERSQHKNKARAMSLLKAKIFDQEKKIKEAKHAKIRKKLIGGGDRSERIRTYNFPQSRITDHRINLTLYKLEDIMSGNLSLLIKPILKEYKSILLSKK

SEQ ID NO: 321 - protein, 193 aa, Candidatus Endoecteinascidia frumentensis
MNIKLIIGLGNPDVYYSNTLHNAGKWWLYKIVENLGGCFFEEKKFTGKIAKIINHKRKILFFSPNTFMNETGNSIINIIHFYKIKPNEILVGHDDLDFPCGKIKLKYSGGNGGHNGLRNIISYIGSNFWRIRIGIGHPGYKKKVQKYVLQKVCTEKKNKINEAIIFFLQYIHLILEGKIYQAMQEINSNIKVS

SEQ ID NO: 322 - protein, 201 aa, Candidatus Endoecteinascidia frumentensis
MESYFQIEAIDRKDLGRKASKKLRREKSYIPAIIYGNSNSVFHISINHNKILDILKKEKIFSSIINILINKKKEKVILQDIQYHPYKTKILHIDFKRIDFYAKLKIKVPLYFKGIHNSPGIKSGGKILYFTKYITILVLPKFLPQYIEVDVSNMKINQILYFSQIPLPIGVSIFHLVKMKDNRPICKIEFIKSSVTKENKK

SEQ ID NO: 323 - protein, 444 aa, Candidatus Endoecteinascidia frumentensis
MIKKLLIANRGEIALRILRACRELQIKTVAVHSTADRNLKHVKLSDESVCIGPSNSLKSYLNIPAIISAAELTDSDSIHPGYGFLSESSDFVSAVEDSGFIFIGPTIENMKNMGDKISAINIMKEHGISCIEGSLGKLDSDTKKNQILAEKIGYPIILKATKGGGGLGIRVVYDPEKLSNSIDMTKTEAKASFGDESIYMEKFLENPRHIEIQILGDGKGNAIHLGERDCSIQRRNQKVLEEAPSTLNRKDCENLAKKCVEVCKKIMYRGAGTFEFLYEKGEFFFIEMNTRIQVEHPVTEFVTGIDIVKEQLQIASNQTITYHQNDINIKGHSIQCRINAEDPKTFLPSPGTLNIYHPPGGPGIRVDSHIYSGYTIPPYYDSMIGKIISYSKNRESAIELMKNALIETYIDGIKTNIPLHQKILENPNFKKNIIDVHFLSNFIL

SEQ ID NO: 324 - protein, 152 aa, Candidatus Endoecteinascidia frumentensis
MKINHKDIQKLLELMDNFSLSDMKIVQGEESIQLSKKLDVSNILSSERETKKKLKKSNSIKFSNKEKQVSDIYSSINIIKSPMVGTFYRSSSPTAKPFIEVGSFIKIGQTIGIIEAMKTMNHIESDKSGIIKSILIEDSSPVEFDQPLIILE

SEQ ID NO: 325 - protein, 262 aa, Candidatus Endoecteinascidia frumentensis
MPILVDSHCHLDILNLKELKMNLADIIDEAYHKNVKYILSICLNIENLKTIIPITKKFNNIYASIGKHPNEIKGKEPSTLDLINIFNAHSKIIAIGESGLDYYRTKSEKHILVQKKRFINHIQASKKLNAPLIIHTRYASQDTIAILEKYNVNLGVVHCFTESWEMAKIILDMGLYISFSGILTFKNSENLRDLVRKIPLNRILIETDSPYLTPHPFRGKSNKPSYVNYVAKCISKIKNLSYSDICHVTTDNFSQLFNIQIF

SEQ ID NO: 326 - protein, 304 aa, Candidatus Endoecteinascidia frumentensis
MIFFWQKTLWKKFNWHLQNNKIPYGLLLTGFPGIGKLHFVKLCAQKILLCNSSELSEHPDLLHIKPQGKLNQIQIDQIRNIIFFLQRTSWIGGYRVVIIEKSHNMNLFAYNAFLKILEEKREKTILILTTDYLESIPLTIRSRCQIWYMNFFLEEKNQNLKNFFWEYEINNSKNLLNIFNIPGFGPIYLKIWEKKGYLKKINSVFQNFLDKKTPIFQTKKLQDIDLVLIINSLIQLVYNLIYILIFKKKNSIFWKLAKKKSLSQWFCLIDFYLIERKKIIKIDYLFNTELFLEGLFIEWYSYNE

SEQ ID NO: 327 - protein, 31 aa, Candidatus Endoecteinascidia frumentensis
MPIKFFPKSFLPKKYHNNYILKKYKEIIIFI

SEQ ID NO: 328 - protein, 32 aa, Candidatus Endoecteinascidia frumentensis
LNKNIYFVVIYSNENIQNLSCKDIDFIENINL

SEQ ID NO: 329 - protein, 268 aa, Candidatus Endoecteinascidia frumentensis
MQRYRFYREHKFIIPLINDITRKIASTNFQNNEEISLLIKKLSNLQLVLTKYSEHEDKAYHSLLVNKGSNIHYDLENDHNDYEKKFCDLKNLLKIIKDLKNKKEKIAYGYKFYLNFREFEVKNAIHMNNEELYIMPKLQQLYSDDELQAIELKTYKLMKVSEIIHMMKTIFIYMDANDRLHYFNDINKSSPEKIKPILCSILKIKKNNSYLISKKEKYFLLNYFSISKEEYKNINVEDKNKYLWELSEGEFIEENMSMKSQHDPTRKY

SEQ ID NO: 330 - protein, 361 aa, Candidatus Endoecteinascidia frumentensis
MDKKILKPCYRNDSILDHNQLNKLHELTPIIFGASAFQYLNAGSEIGLFELLYYSGPKKKSELMIELSLKERAVDILLLGNTSLNLINKEKSFYKNSLIIQTIFENNIWDIFKDLIAFEQYIVYLGQFDFTDSLRKNTNIGLQRISNTSSSLYKSFNKNKKLEKIFYNYMNSWTRLSNYYLIKYINFNNVNRLLDVGGGTAINAIALAKKYPKLKITVFEIDASAKIAQKNIQSSGLSNQINVIHGDIFKDQFPTGYDCVLFSHQLVIWTPEENIELLHKAYKILSSNGLVIIFNSISNDDGKGPLLAALDSVYFASIPSEGGMIYSWNQYEEWLKKTKFQKISRINCHNWTPHGIIKAYK

SEQ ID NO: 331 - protein, 648 aa, Candidatus Endoecteinascidia frumentensis
MNEKDTLKGSYIFSASPGQERLWFLKELNSQFGPAYNIPALFKINGFLNIISLQKSMNKIVERHEILRTALIYDGTKLLQVIKPNFLKTIRYVDCTIKEKRKKFLESSLIQESSVHFNFTQPGIFDLILYKFQEKVYYILINIHHIISDGISLEIFVYELFEYYSFIENKIKIKKKDLEIQFADFVKWNEKWISSSKYLEYELFWKKKQKDFVLNLTLPKRNRNIDTIIGNNVNFELSSSITDLLIKEAKKLHVSLYAFYLSIFAILIYFFSNQKKFLIGIPLANRKNQQTQNIMGFLANTLVLNINIDLNQNLSDFIKYNHKNILKLIKLERFPYSSLHKISTNNIHNSEPIFKVMFGYQELENKKFNIKELNIERINFNTIFSKFDISLFMFQKGKQHRGLLECRSHIFSKKESENFYRYFSNICRIAKNTNILIKNIQFYENNDIKFAKNLLKNLDNLYLNKKILEKLEEFNIKNKKFSILDTTYKQVPINIPGILFINHHNTYLKVRLTYDKKLNLIEDNKKDQSNIIENKYHDFIKANSKTEKILENIWKSLLRLNSSLSIHQSFFSIGGHSILVAKMVNNINKKFNIVISIRDIFLHPTISHIASKIESLKEKEIHNTNINPQNLKNEDIVEIYKDINGKKI

SEQ ID NO: 332 - protein, 1476 aa, Candidatus Endoecteinascidia frumentensis
LKGLDIKILKKKIKSGKTNLTHNQQRFCFFLNMDSNFPSSDAYFFEANIFFDKAILQQSIAFSITNFPIFRSIFINIFGSPIRKTQLSSIISIKLDNLYQDNNKIDKDQWISNNKKNNTINISQGPLFNVFCLKHSDKKFNILFLVSRLVSNKKLIISFMKNIFFRYQNFLYHNENEKIISYERNISEKFFYLENQWIETENFKNHIKFWKKEVKDLSDLDLQTDFKRPEIKTNKQKSVFLKLGKYKILNIFNKIKKEKYNYEEFFLSIFVTILYKYSNNNNFAVGVKANKLEKYFDKNNISPIENELPFKINLNSSFSFKKTLSIISEKYNLFLRYSTLPIKILLDNIGINRDLKKTPFFQVSFQYENFSFPIWNNKKNNFLKQIPILEGINIMDFTFCVIETKSSFILRIDFNPDLFLDSSMILFLSAIEELLMFISNKSWDISIKDLSIISNMMFKKIEKRWNAPKKILFENFEVHKNFENQCKKTPSNIAIICQGETITYRELNERANQISHYLIYKKLSFNEKIGILMDRSIEFIISILAILKINCIYVPIDEKYPIERINYIINDSQIKLLITKSYIQKNKNIIYKNLIYLDKDWPLIEIKSRENLNFSTNIQKNGMYMIYTSGSTGQAKGVILNHFGVLNNISWRQNKWHLNEKDRILLNTSFSFDPSIWSIFWPLLFGGAFVIVPLSIQNDIYALIKLIKKYNISIIGTIPHIIDLLVSNIAIRNCNSLRLILSGGEPLSQKIVQKVFNRTNAKLFSLYGPTEATIDAGFYECKPDDIVQTAPIGKAIDNTRMYILDENLRHVPDGVKGEIYISGPGVALGYHKRKDLNAKSFLKDNIFYSELKYMYKTGDLGVFCYDDNIKFLGRIDNQVKIYGNRIECSEIESVLINIKKVKESAVIVDNLYTEKTKLIAFLAVSELDVKKEDIQKKLKNKLPKYMLPDKIILLISLPKLENGKIDKNALFRIYNTSKNNKSELLENKLPNNSIEKIVFKYFCDVLSLSNISIHDDFFKLGGTSILLARLSNLLFNHFDISLPLHQFFKIPTVLGVSNIIVTLQKEGIDKALLDKHISKLEEDAELIEDISPKNLPKGNFYNPKNILITGSTGYIGSFILQELLINTNATIYCLIRSVNPEKALIKLKNKMKEFYIWKEVYTKRIVCLVGDLGEKNIGLNKKVWENLSKKIEVIFHAGALVNFAYPYSALKAANVEGTKEIFRFSCKNLLKSVHYISTIDVLLATHIPRPFLENDAPLKGSIDIPGGYTGSKWVAEKIAHSAMIRGIPTSIYRPGLVMSHSKTGATQTNDYLLVAFKGFIPKKVIPEYARIFDIVPVDFVAKSIVYASMQKNVHGKFYHIFNPKPTTLYQFCNWIKNYGYSFDIIPFEIGRKIALDSKESDPLYPLVPLIRDADPNPHRPLDPKYINEVQPEIECKNMNTILQKSGIICPNMNERLTHLCLKYLINIGYFPHPKKI

SEQ ID NO: 333 - protein, 1790 aa, Candidatus Endoecteinascidia frumentensis
MKKMINYKEHEITSFVDIILLRSHSVPDKKILTYLTSFDEKKELTYKKINKISQQIAVKILHYLSPGDRALIFHKPSIDYITALFGCLYAGIIAIPVYGPEHGINKNKLYRLKNIIKDSGAKGILLSYKELNNCKQFFSNFYIHKEKIHYITTDDTSNIDFQDWKKPYFNKNNTSIIQYTSGSTSDPKGVMLNHTNLISNILSIQNIFEMKKDKGKAVIWLPPYHDMGLIGGILTPIFVDFPLILISPLLFIQNPIFWLKLISMEKATITGGPNFAFDLCSNKAIIRKLNNIDLSSIKHIFSGAEPINPEVINKFFEIYEKFGLSKKSFSTCYGLAESTLMVTSSKIENNKEIKEKKFFFKKNIVEIFKKNQKSFSLSKKLFSCGKIIPNHKLAIVDPKKSKKLNEKVIGEIYVKGPSVSKGYWKNPKKTKNIFQNFFIKENKKKSYGWLKTGDLGFLYNSQLYVTGRIKDLIIIRGENFYPQDIENYVKELNSKIQLCNSAAFEIDKNHIKEVVLLQEIRKKNLSENFENLALDIRKSILDKLNLLIHNIIFIEKGALPKTTSGKIQRFLAKKYYLSNSFNIIFSFNSQLKEKYKKINYVQKYYIQSLKKEEKKIYFSIIKFIKRYQNLNKDIINFTILEIGLDSLHIMELKNFLEEKYKIILNMHSFVEDTKIFTLVKEVFNKHKENIQKIYIKKEKKKNVLKNQVSKYFSVDPGKSSIYYNYLVQKENSIYEIFRIIKISKSINIELLEKSIHILLNMYPTLKSRFIVKNTGIVYQEYPVELSFSSIFRKINCKDIDLKEICNIFLKERFNMEKGPLFNIIHINNVKLDYNILIFKIHHIISDFWSIIIIYQNIENIYNNLLKNNSIKNIKIHETSQDVQNKNYKKYIQSNQFIEDNLFWKRYLSKYNLLENTNNIKRKNIQSFQFNLNFNFYNNLLIFSKKKKITPYTILLIIYQITYYRIYKRDYFITGTPVALRDDYLLRNYIGYCVNILPIVSDFSKQNDIYSFTEKVKNDIKNILQHKYFYFSKIIELLKLPRNTDYIPLFNSLFIYQTDHIGSFNFLNTIAANIKDSEFQFLGYPASIWYTNNFNLMHHFIFNISVNKESYSINIEYDENIHNKILIKKFSEQFKLTFQAIIFNKPKAIIEEKQYLFYQNINSTNKKFFKSQYFLDQLFRKQVIKNPNASAIIFNDINITYQKLNKYVNRVSHYLINHILKDEILIAILMDKGIEQIVACLAILSIGKAYLPININFSKNKIHEMMVLGKVKRFLTQKKYLKKFNFKDFQSIDVTSIIENSSFKESQEYFPKYQLRKLNDLAYVIFTSGSTGTPKGVMIEHKQVVNTILDINEKFQVNNLDRILAISNLDFDLSVYDIFGILSAGGTLVIVPSKFTKEPKYWLYAIQKYQITIWNSVPMFKQMFIEYLQGIDKESFYKKIILKLILLSGDWIPLDLPKKIFKIYKKNFDSLKVVSLGGATECSIWSNYFIINKNIKYKTSIPYGKPLSNQHLYILDALMLPTNILVPGYLYIGGFGVARGYWNDLKKTNESFYFHKEIGKRIYFTGDMGQYHPDGNIEFLGRKDRQIKINGYRIELEEIQNKLKSHVYVKDSFITVNQNNISAKILAFIILHNSSSMMSHTNIKKELKSFLYKNLSEYMIPNHFQFLKKFPLSKNGKIDENKLYKMHNVPILNIQKSANTKLQKSLKKIWKDLLKIKKDIYINDNFFQLGGSSLLAVRMTNLISKKLNLNIDVSAVFKYQTIESLEKFLQKDKIKIEKNNITKQERILYYE

SEQ ID NO: 334 - protein, 668 aa, Candidatus Endoecteinascidia frumentensis
MNSINSIYLKNNKILTEKIIKKCMLIRLVEERLLQAFSEGELYGTIHTCIGQELIGVMACQFINQTDTIFSNHRCHGHFLSFTNDVEGLISEIYGKKTGVCSGIGGSQHLYKNNFYSNGIQGGFMPVAAGLAYSFKENNKIAIIFIGDGTLGEGILYETYNIIALLKLPLLIILENNLYAQSTHQKETLSGDILKRAQAFNIYADKSDIWNWNALYKKMEFMINYVRHYRSPAFLEVSCYRLKAHSKGDDDRDKNEINFYKKKDPVKIIMDQIFHKLQKKSIISLIRERIENAICKAKKDVYANYKIYQYKNYNIFNNYQNLYVNCKKNKRISTLLNNTLHNVMKENSNIILLGEDIKDPYGGAFKITKGLSSKFPDRVINTPISEAAIIGFSCGMSLSGLLPIVEIMFGDFITLAFDQILNHASKLKYMYNYNVSTPIIIRTPMGGGRGYGPTHSQTLEKHFLGIPGIRIFAINNLFNPEILYKSILKNNQELSIIIENKILYTKNLLSFPLKGYFYKFKDYPQPTIMMLPKSNLIDITFITYGGLVDIIVEIVEELFEEYDLIAQLICPIQIYPCQLSEFSNLIKKSSLIVLIEEGQGFANFSSEMLSQLIENDKFKNCNFLRCSSEPSPIPASIHLEDKMLPNKTNILRNILEVYNEKKNVNSKI

SEQ ID NO: 335 - protein, 361 aa, Candidatus Endoecteinascidia frumentensis
MLIPRFEANDNSVKIIEWLVNDRVFIKKNTPLLNIETSKTFQEIKSKYDGFIKKMCQEGDTLHTGDIFIEFYTKLEDLLKKNTYFKKKKDTVLSRKSIYQRFSKKAKKILLEKNIDISSCTEELITTKVLNNITNKIQKNKKNKDLIKYFPNLKIKKNSDIKNREISVLEKSDGNIFSSSIMIQLSSEKIRENIKKIPKLNGQIFPYLMYFYIQELSISPKFTAFYRERNIIYYNRINLGVLIDNNNILQIIVLKDANKFSLLELQNELIDKICRCYENNLEIDDVVHSTTSVSDLSGNNIISFQPIINQKQSVILGIGGDTNLLGKPITFNIVFDHRILNGKEVAIFLENFKRKILQGIY

SEQ ID NO: 336 - protein, 497 aa, Candidatus Endoecteinascidia frumentensis
MYNKFEVIIIGAGPSGLMLSIELALRNISCAIIEKRKSRLIETRAFGLMPLTLNLLDMRGLANSMISEGIICNYAPLGDGKGKLYFHSLKTKFPFLLSIPQEKTEEILEKRTIQLGVKIFNNYELLRFEEKNGDFLLFCKNKKEENIFISRYLIGCDGSYSSVRNLAKIPFTFLKQNKTLMHGDVYLKYPPKDKIFAKTSKRGMIAIFPHKNGSYRAIALDQKKMLIPVNTKLTLEDFSESLISLSGGYNFGINNFIWLKRFRVQQKQSQSYQKGKIFLLGDAAHTHMPAGGQGLQVAIHDAFNLGWKLAFYIKKKTSYNLLSSYTEERRKINEIAMKRSSMLFKYEIANDIFSMSLKWTINKLFSFKFMQKYFAKDMSGLSTNYHKIFSKKKNYKKFKCLGYFIRDIKIYTHDNTLRFLYSFLKQGKFVFISIIHQISFISWKNTDIIFLASDDIKKIYGVNCCLVRPDGIICWAGLDTKKFTKNIFYEIIFLKQE

SEQ ID NO: 337 - protein, 220 aa, Candidatus Endoecteinascidia frumentensis
MINHIQINENILQYIRNTSLRESHTLKKLRYLTNKLPERNMQIFPEQAQFISLLIKLMKAKMALEIGVFTGYSSICIAKSLPENGKLIACDNNIKWTDIAKKFWKIEKINHKISLHINDALLTLKKLLLHKKEYFDFIFIDADKENYINYYEYSLKLLKAGGLILFDNTLWSGKVTVSQNIKYNADTKIINDLNNFLLSDNRVEISLLPFADGITLALKK

SEQ ID NO: 338 - protein, 335 aa, Candidatus Endoecteinascidia frumentensis
MLKNNFLLLPPEKLPHNQKELIFLQNSKNTILLKNSFSEIIHKNDLFIIIQKILKSYEKKIKNFSIISNDCYESKKNHDNDLAFRIIRVDGPILEVLNYSVIKTYHLLFLDLKKSGTSLSRKNFNILIKTLFTLLFLYNPNTHCSISNKFYSKLKIKNYIDKYNAYKRWIHGHYLFMVIIQGLIISLQCFIFEYSKKKFLQSLLYLDNAIKLMKATEVALYYTGEFSSKSYNENVRPTLMPPISQPEMSGLNWRDHQFMVKNCMRSIGKLNFTSCPIIQKKYNSFIISLKKAYHAHKYVCGKFVGPASGSLRSNEYSAVQEIEKFKKLRLKILKG

SEQ ID NO: 339 - protein, 748 aa, Candidatus Endoecteinascidia frumentensis
MLNSKKSLLIQGLYGKIKINLDSYGIPHIFTSKNDIDAFYGLGYMHAKDRFWQMELQRHIASGTLSEIFGKRTIKEDKYLKTWGFYRCAKENWKHFNIKTKKIINGYTAGVNAYIKSGKRPIELRILFYKPKYWKNIDSFIWSKIIAWQLQYHTWQDKLNNSLIMEKSSDINIEDIRIQYPENAPTTLNIEELNKSNLLDYTQKSSDNLNTNKKNQVLYNNNMQSFINISQEIQNNLNIQNLPGKGSNGWVISGKLTKSGKPILANDIHLELSSPNICYLANMQGPSLNIRGSSIPGIPCIISGENKNIAWGITDAGLDCSDLFLIDKTRPTKKIFEKIKVRKKKTIQHEIELSDIGPIINNLIQENDQINKKIINQKIAIRWTGLDSDDKTIQSLIETNYASNWKEFKNALKDFTAAPMNFLYADILGNIGYYLPGRIPIRKKENLKYVIPFNSKNAWNEFIPFNKLPHVFNPSKGYIVNANNKIIPNEYPYNLTYIWKGPPYRAEKIEYMINNMNKMTIKNMKDIQINTNNLLWYELKDFLLKIIPQNKFEKKILIYLKKWNGNMSSNSISATVFSFWFQEIIKIQPKLPINYQNFPNPLFIIDQLKKNGKFICLNKKKNITDVLYILFKKAIVNIKNILGNNIEKWKWGKIHQAKFINPIFGKIWGIKYLWNRKISTEGNAYTINASPYDENFIQKAGPVYRQIIDLNKKNKSYFICPLGQSGNPFSKNYDNMLKFWKLGKYIKL

SEQ ID NO: 340 - protein, 486 aa, Candidatus Endoecteinascidia frumentensis
MIKWNIAIGLEVHIQLSTESKIFSKAKNQYGNTPNTQVSGIDLGLPGTLPILNKRAIEFAIRLGLAINAKIPTYFLFVRKNYFYPDLSKGYQISQNKIPILMGGYIPIAINDSKKYIKKIFIHHAHLEEDAGKLVHTEKNAQIDFNRSGNPLLEVVTKPNITSAKEAISFLKELHLLVRYLKISHANMEKGEFRCDVNISVSSLGSSMLGTKTECKNLNSFKFIEKAIIFESKRQIALLESGKFVIQETRLFDSKKNITKKMRIKEHEHDYRYFPEPDLLPVKVTYSYIKNIHLLLPELPNSIRNRLKSEHYLDNKEIEMFLENPQLLNFYEKLVFSVGLENSQLASNWITSILLSKLKKYKLSVINSPIKIHHLSNIIFKIKKKLLSNKTAKIVFNNLWITNGKSHIDDIIYKKKLLQINDINIIEKTVNEVIDNFPKEIIKYHNGKTKILDFLLGKIIQKNKKANPKKIKEILIKKLFLKKNAN

SEQ ID NO: 341 - protein, 485 aa, Candidatus Endoecteinascidia frumentensis
VIEYHSLKSISNALKTKKISSVELVKYYLDRIFKYNKTLNCFITITYNHALKQAEYADKKIADGKANILTGIPIAHKDLICTKGIKTTCASKMLKNFISPYDAHIVKLCKKSGLVLLGKTNLDEFAMGSSNESSYFGPCKNPWDLSRIPGGSSGGSAAAISANLTPIATGTDTGGSIRQPASMCNITGLKPTYGLVSRYGIIAYASSLDQAGPMGNSAEDCALLLNIISGYDKKDSTSSLEHKKDFTKILNNSIKGIKIGIPEDYFSKGLDPKIELTIQHALKKYESMGAKLKSIRMKHNDICISAYYIIAQAEASSNLAKYDGIRFGYRCQNPKNLWDLYERSRGEGFGEIVKQRILAGTFMLSSEFYNSYYIKAQKIRRLIFQDFQKAFEKVDVIMGPTSPILPYKIGKNKNDLSLLYLSDMYTLSLNMAGLPGITIPAGFVKKLPIGLQIISPAFTEEKLLNIAHQFQLNTDWHMQKPQNIL

SEQ ID NO: 342 - protein, 102 aa, Candidatus Endoecteinascidia frumentensis
MYKMYLTTEEIKKLSKKSCIKIDNKEILQTKKQLDICLNVMNKISLINTNNIKPLYNISNKTQILQEDSPIKKDFDNKYILKNAPSIDHENKLFLVPTFLSK

SEQ ID NO: 343 - protein, 481 aa, Candidatus Endoecteinascidia frumentensis
MDILQNAKEILLFSNNLTENDIQKEINIAMSYNIDFIDLYLEKSETENWILDDRIIKTGYYNISQGLGVRTFLGETRGYSYADIININSLKESIKRAKNISSFRKNIKLNYFNNVKKNHCVYISKNPLEEYKQFQKISFLKEIDKYIREKNANIIQVIVQLYSSLKTILVAASDGTFAADMRPMVQLRISVILQINNKIEQGNAGIGGRYSYRVLFNPKNWKKIADEAIRIALINLKSIPLSAGLMPVVLGSGWPGVLLHEAVGHGLEGDFNRKGVSNFSQKMGKLIASPLCTVIDNGTIKDKRGSLNIDDEGTETKKNILIENGKLVGYMLDKHNAFLMKKKSTGNGRRESYAHIPMPRMTNTYMLPGNYELQEMISSIQKGIFAVNFNGGEVDITSGKFVFVMSEAYLIEKGKVTKPLKGATLIGDGPSIMKKISMVGNDLSFDLGIGICGKNGQNIPVGVGQPSLKIDEINIGGTKIK

SEQ ID NO: 344 - protein, 161 aa, Candidatus Endoecteinascidia frumentensis
MSGVGKSTIGKQLANELKMVFYDSDEIIEKRCGAEISWILDIEGEEGFRKRESDIIYELTEKKGIVLATGSGVVLEKSNCNRLSARGTVIYLRASLRLHVERSLRDKKKYLKQKQNQEIELRKIQEKRDPLYNRISDIIIDANSNSIRSIVNDILDKINEK

SEQ ID NO: 345 - protein, 134 aa, Candidatus Endoecteinascidia frumentensis
MLTKTELLNMSEDSYMNKKQYEFFEKILCQQKKDLILSISETRKRLSENENSSDISDLATKQEMQQIFLKTVERQSKLLQKVQKSIENIKNGTYGYCQETGEPIGIKRLLARPTATLSIQAKEAKEHHERTKGN

SEQ ID NO: 346 - protein, 305 aa, Candidatus Endoecteinascidia frumentensis
MHDLKNFFNIIRKMIFLFFKNIIVYIALVCVIIMWSLSYVGIKDTLKYFHPESIGFLRFFFASLFIFPWYFFLIPKKYILQQYDIFLLLITGSIGIGMYTILINLGEKTVDPTITSFIISLIPVFVSIITFFFLNEKINTMGWIGIVISLVGIAMIFIQSKSINYGIIYLCLSALCGAFYTIMQKPLLKKLSPLEITSWCIWFATIAMSFSAPIAIKEIYYAPRKEIISIILLGIGPGALAYTLWSFCLNHLQRRVVANSLYFVPFLSIIFEWIFLKKIPSWKNLLGGIIILFGVIVIFYKNKNK

SEQ ID NO: 347 - protein, 250 aa, Candidatus Endoecteinascidia frumentensis
LKNDIIVFDVSNLFYISAYRLQKKNIKNNNYNINTIYSNTIQFMRKLYYFFKSKHIIFACDSTQYYWRSKYFSEYKKNRKMTTLRKNVRNSIKFFKEKNFKLCIEVPGCEADDIIYCLINYKIHNNIIIVSSDRDFIQLQSTRVRLFNPHTYKFRKIPEKLEYELFIKCIRGDVSDNIPSAYPYVRESLIKEAYYNPYKFFIFMKKKLSDNIAVYKKYQRNRLLIDMKFLPKKYISLIKILIDKLSLIEE

SEQ ID NO: 348 - protein, 278 aa, Candidatus Endoecteinascidia frumentensis
MFITGKISKIENKIDEFGKIDYFLFLDEKKIFLNNLLGKYISLEHIKNLIFCIGCQKKMKAWYRNNYCFLCNKKLAICDICIIKPEKCHFHLNTCREPEWGWKYCMNIHYVYLSITSGAKIGITKKKNLIFRWINQGAIQGLLIAKCLNRRIAGLYENYLTKYIADKTNWRKMLSNIINFSDLKEIRDQIIWRSQKSLFLQKFFNEKSILILKNEKIQNLIYPIINYPEKIQLFHFKKKLKISGILTGIKGQYLLFNNTVINLRKHLGYKIHFYQNSL

SEQ ID NO: 349 - protein, 518 aa, Candidatus Endoecteinascidia frumentensis
MQKKMKNGDTIHKEDFIQSIHNALQFISYYHPIDFLKSMVKAYKMEKSKPAKAAIGQILENSRLCAIGHRPICQDTGIVCAFVKVGIHMKWNDNNNMSIEEMINEGTRRAYSDNTNPLRASIVKNPLEDRKNTKDNTPAIVHISTKNSSDIDVAISAKGGGSEFKSQFTVLNPYDSLVDWVIQMIPKMGAGWCPPGILGIGIGGTSEKAMILAKESLNQNIDIHKIMKYGPKTYIEKLRLEIYEKVNKLGIGAQGLGGVTTVLDVKIKKFPTHAACLPVAMIPNCAATRHISFNLKKTGEVACFTPPSISHWPKINWKKDYSMIKKVNISKLKKNEILSWKVGENLLLSGKLLTGRDAIHKKIENIIKNKGNLPVNFQGRFIYYVGPVEKTNNEIIGPSGPTTAKRMDKYTKCMLSEKVGILGMIGKAERSDQTIRILKKHKVVYLIAVGGAAYLISKSIRSANIIAFKELGMEAIYEFEVVDMPVIVAVDSSGNSIHKNGPAFWKKELKHIPIYPYK

SEQ ID NO: 350 - protein, 284 aa, Candidatus Endoecteinascidia frumentensis
  MISC_FEATURE: EtuM4 (N-methyltransferase)
MKFLKILNINFSKVKYNLNKTANTYEKYENFFKKIESNLLKNLIFFNYKPNNILNLGANTGNFTLEMYKKFSIEKIFNLDLSEKRLKIAKKKNIQNILVSYSHKMPFPKESLDMIVSNLHIHWYNSNLKELFVEIYSLLKNHGLFLFSSFGPKTLQELKLAWDKIDNYIHIHPMVGICDIGNILSNIGYKNIVINTEKYKIYYLHPKYLLKDIKALGLTNCIKFSFSKFYTPNQLLKFYQSYPKNKLIDSPYTATIEVIYGIGWKKIQDVKNQKKYINIANIIK

SEQ ID NO: 351 - protein, 693 aa, Candidatus Endoecteinascidia frumentensis
MIFFFIFCIFFYILNSNIGCQWTLKIFYPFFQAHNIYFVPNKINGKITNIFIPKIEIKIKNSKKKIILKKVHIMWSIKKLIFSQNFDIKKISIYSIQYNHKNQNDFSFLMKNIKKFINYNIRIENFSIQKIYKNIFHIETIYGKIQIYHHKIFLINLFFNSNPQKKEKFFGKIKIVNRINSIYNGILYVNIIHNKKCCSRGKILFTLDKNKIIVKPFSIYFLNKKNVFISHTCMYFFKKPKKWAINLKISISNLEEILSYFPKVKILFILNNINKNKNSKLYIENNNFILISYFKYFNQFIKIENLYFSSHKERLIVNLDKFDFNSILYNRIVYGNTYIINGNIFFKIIFAWNTIHISFYKKEDIYISQPLLFTSKINSNIELLYNFFKKSLEIFGNIILSQGYININKIKENLYNKDIILINNKNIKNKKLFLYIKNISLNIKNMTVYGSGLKGKLKGNLKIYNDYNQKKNSIFLFGILFIKNGFYQIYNKKFSIKYATITYKDNILQNPTINILGEYIYKNINDNLLTDGIITLHILGKIDNIKIYFSSYPRKTQEDIISYIFLDTTIQKLQNKNQLLLSLISVFLNKNNFFKLIQNFLNIDLITLGKINNLLIQNNSNVNSNSYFLSLFKNNLALFMKKNITSNFFITYGFGLLNHEQEMQIRIKINRKIYLYLFEINNALGINFIYSIY

SEQ ID NO: 352 - protein, 601 aa, Candidatus Endoecteinascidia frumentensis
LKINIIFFNKFNHAINLYGIFLLKILIFFIINIYFLNAQSKIQIKILGIPQNLLYKIYSNLDIKKFKLENNQSNLLFKKNMIKNQNIIISILKSEGYYESKIINFMQKKKNEKYKLIYKIYPGKPILIDKLSIKIKGSGKSNKNLKNILNSYKDIIGTKFVVKYYQDLKKKILKVAKEEGFLQAFLTKHIIKIDIKKHKAFIYIELLTGDQYYFANTIFKQKNFFFQKHFLKKYIPYKFREKFTFKKVHKLQNQLNNTIYFDDVNIQTIINKKTKNVSVIVNLTAKKPQNLLIGIGYKKNKGITGYFEWNVYHITNTGIYFKLYGTISIFHPNLTFKYIYPLDSPLYNYISVNINQFFLKIIPYTAFENNIKITYFNKIFDFLSFNFGLSEIISKSTINISKKKINTNFFSSFLNIDIKKKQKYNNFCTFIFFTHLSIIGSLKNILSPYNFLRNILDMKLKIKYAHYGIEWNVIIGTIITNSFNLLPPEFRFYVGGVNSLLGYPYKSLSPIDKNHGLIGGHYMIIGKISFLYYINTNVNISIFYNAGNSFNYWKNLYFAKAIGMGINWKTILGNIHVYFSRPILNNIYKKWRIDFSIGKTI

SEQ ID NO: 353 - protein, 626 aa, Candidatus Endoecteinascidia frumentensis
MKYKKHKIFNYLNTEKNIYIKDIVFILFITISIFFITTIFSYNPADPIYLNNSNSKIIVHNLNGVIGAYLANKIFLLFGNISYFLPLFFLYTNFFIYQFFFLKKNINIYLICIKIIGAIFVVASSSGISYFLLKFYNCNIYSEKIGGILGKNIIHIINPYLNSMGTILLLLLLLFIGITLFIGLFWLNIIKTIISLTIFFFIFLFKNLLKIKNFFLKKRTKNPIYFFLKKKIKNKRLKKNNFYKIIPSIELLDEPKKRSDFTFLNNAKFMSSFLEKKILEFGFVVKVINIYVGPIITRYELKIPPGFKTNKIINLSTDIARSLSVVNIRFIAIIPGKPYLGLEIPNKKKHVVQLKEVLSSEEFLSHPSSLAMGLGLDVSGIPKIADLSKMPHLLIAGTTGSGKSMFLNAILLSMLLKNNAKKLQLIMIDPKILEFSIYQNIPHLLSPIITKTEKANNILFWSVKEMNRRYKIMAKIGIKNILEMHNNIKNKKNINDNKKEIFPYIIIFIDEFSDLISENKQIEKYIIQLSQKARASGIHLILSTQRPSVNIITGVIKANISTRISFQVSSKIDSKIILDQQGAERLLGNGDMLYLKSGKTPIRIHGPFVSNQEIKKIVNFFKKVNY

SEQ ID NO: 354 - protein, 862 aa, Candidatus Endoecteinascidia frumentensis
VISYSNFLIEDNHTPMIKQYLSIKKNYPNILLFYRMGDFYELFYEDAKIASEILDITLTTRGKSKGKPVPMAGIPCRTVDIYLSKLIKIGKSIAICEQIEKPKTEKKLIEREVVKIITPGTIVEESLLDPSEECILCSLYQSKKKFGLSIIEMSTSRFEIIENIGGIEKIKNEFFRLNPKEILISEKENLENIKRYNIKKVPDYYFSKIESKNFLQKKFKNCDFFNPLHTNYLPLAMIASGALFKYLQKNRKSNFSHIKNVKHIQLNNFLIIDENSRKNLELINYENSKKNTLLKIIDTTVTPMGKRCIKRWISHPIKSYKNIRYRQLSIEEIIKKTCFQEISYILKFIGDIERVNGRISSYSAKPRDLTSLRSSLKKIPDLLKITSTCNSYFLKKISKDLYPQKKILDLLNSAIAEHPPISIQDGGVILKGYNLELDDLRKKVKKFRNCLISFEEKERKTTGIKTLKINYTKISGYYIEISKIQSKYVPSHYIQQQTLKNSNRFITKKLKEIEDKIISTQERIIIKEKNLYFKIIQNLNQWFFILQNLSKKIAILDVLSCFAERAVSLKFCKPILTQKKIINISYGRHPVVEQVMDKPFIPNSINMNKDCKLMIITGANMGGKSTYMRQTALIVILAYCGSFVPAKKAEIGRIDKIFTRIGSSDDLSQGKSTFMIEMQETANILKHATQYSLVLIDEIGRGTSTFDGLSLAWACCEKLSKISSYTLFSTHYFELSKISEEVKTIKNYHLKTIEYLNKIVFLYEVKQGSINESYGIKVAELAGFNKNIIKRARKKLQNLKFQNEKIINPKFTNTILNPYLHSKYIYFLEQSICSLNLDKFTHKMAWNYLYKIQKKLLCEIKK

SEQ ID NO: 355 - protein, 291 aa, Candidatus Endoecteinascidia frumentensis
MNYFKIVKKYRYFIEKILTSLRFIFILILIFFLNISFANRIITLAPNITELVYKLGSGKDIVGVSSYSDFPKSAKFLPIVSNYTYIDIEKILYLHPKLIIGELSNGKNIQWNKEFKKFKISSFWLSINKISDISQMFSKLGKLLKKENTAKIKEKYIKNIFDKIILYKRRKKDKIPKVLLQISYQPIFVASGNSIQTKIICFCGGNNIYYKKKKFFIPIEIEDVLKKNPDILFVMNNFQKKFWEKKWPILNAVKKNHIYILHPNWILRSGPRLIYGLKEICTFINSFYKKS

SEQ ID NO: 356 - protein, 338 aa, Candidatus Endoecteinascidia frumentensis
MINLKKLTILKEILIFISQKQKILVSEVLKKKKISKFTLLKYIKYMQTFMAIDIKIILNKIYVFPGPYFPLNQKVIMNKLNMKSLNFIKNIICYDCVSSTNKIIYKIMNMNKKKYGICISEMQTFGIGSRYKIWQSPFGYNIYISILWTFKYSMLSKISILNILVAIVSVKILQKYKVGKYIKIKWPNDIFYNDQKIGGILIERYFDKNKMIKCIIGIGINGYLSNFLKKKILQNSTSFFEETGKILDRNSFIADLINQLISDLGNFKYQELFFLLNEWKKFDFFYKKKIIFTSSHHTIEGIGMGIANNGLYLIKNSKNQIIKLFHYPGKTKIHLHTS

SEQ ID NO: 357 - protein, 786 aa, Candidatus Endoecteinascidia frumentensis
MLKKIFLFIKISLFLICFQIYCKEIINIKKIKIEGLQTIKLQNIISKIPDSINRNFSLEKSDQIIKNLYNTKYFSNIIIFLKKKNILIIKVKELPIIQKINIKGNTKISTFYLKKFFKTFNITPGNILNPNKLSQIKRLLLVIYSQKKLYGTQVFIKKILKSKNQIMITFFVKEGKIKHIQSINFIGNNFISSKILKDQMVLQESGILSFFNKKDIYSNELLNFSIKNIYQYYMNHGYLDFNLLSIKVLNLKNNKNVIIQIHVLEGEKYIFDNYTIQGDIVFTKQRIKKIIKIKKGDIFSREKIIQSIKLITSALGDIGYTFPEINIISKIDKKKKIVRIIFNIKKGKRLYIRYISFIGNKITNDNVLRKQIHILEGEIFNEKYIKYSEENIQKTYPFIINVKHKIKKVKNTLSKIDIDFYVKEKNANTVNANLGFSNLEGLIIGGNINIPNLFGTGNTINLGGSFSKPIKSLDFSYIEPYSVMGIKKSINIQIVNINSRQKIINFARNLYKANIEYAMPINNNFYISTDVGISHIVLLNNNSESETIKKFFIEYGKKFTNYNLGLSIIYNSTNKFWFPNKGTKLNLSYHFSMPGSTILWYKIYLSNVYYFLIKKDYVFFIENYIKYGSNYGFQKKDGIFPIYDNFFGGGWDLVRGYATNSLGPKDTIIDKKGNIKMGDPIGGNLSIVSRLNLCFPVPFIKDSSNMRMGVFLDAGNIYSTKYISTIWDKDHQPKMPNLNNLKYSFGVFIQWISPFGLLSLSFADPFNAKKEDSIQYIQFSIGVPFQ

SEQ ID NO: 358 - protein, 174 aa, Candidatus Endoecteinascidia frumentensis
MKKIYTIFTSIFISTICFSGYGWGNTSSMSYKIGVVDYLSVFQNVPQGKITLDKLKNSLEPKINKLKEESDSLSLKMKNLKKNAFTLSKKEHELQVLSINNEKKKFQKKVIQLRENEIKKERSAAKNFEISMQKAINQIVKSEKYTIILNKQAVPYFSHNLDITNQVIDIMKKI

SEQ ID NO: 359 - protein, 39 aa, Candidatus Endoecteinascidia frumentensis
MLKKYLMENIKKFLIKMNCKDRISNLYKLFDKLFQNKKK

SEQ ID NO: 360 - protein, 149 aa, Candidatus Endoecteinascidia frumentensis
MKLNINYILSFLPHRYPFIMVDRVLNLVPKKYIKTLKNITVNEPFFQGHFPSNPVMPGVLQLESIAQSLGILIYHDFHKKNKPKKGDIFYFIGINNTRFKKPVIPGDQLIMDITLKKQKQRIYIAEGIAKVEESISCKTEIMIFYKEGY

SEQ ID NO: 361 - protein, 224 aa, Candidatus Endoecteinascidia frumentensis
MQKQHTMEKFSSIATNKVLKNTYILLSLTLLFSSFIAGLSIISNSSPTNIWLTLIIMIGFPFLLQATKNSIWGIFFTFLYTGFIGWYIGPLLNFYIKNFTNGSELIMMSLGSTGLIFLVLSTISMNTDYNFSNWSRFLTVGIIIAFISSLINVIFFKIPMLQMVISVLFSLISGGLIMYQTNEIVRGGERNYIVATVTLFVSLINIFLTILQLLGMFSTNSSRD

SEQ ID NO: 362 - protein, 319 aa, Candidatus Endoecteinascidia frumentensis
LLDVFLFLLGIFFLFQSTKWFLYATQLITNYFNCSSWLIGLFVVGFGSSIPEIVVSLYSVFTNHSSIIIPNVVGSNIINILLGLGISLFFIKNKKNRIFNPLHYSNIIIFILSILLLIIGIIMNNFHSWYSILILVLGIINIYWIFVKSIPIKKKYNIQKKIPFFSLYYSIVLLIMSLIILIFSSHFIINSIFNLSKIMGIKSEALIMTTASLGTSLPEISISIFSARKGNIELIFSNILGSNITNFFLCIGLPSIFYTLTSNHNNDYFEIIWLFISGISYLLTYILTLYKKFFLNRIIGIFLFLGFICFSIQCFSLIT

SEQ ID NO: 363 - protein, 230 aa, Candidatus Endoecteinascidia frumentensis
LRNIPLVSASIFQFSAQLSIFNYNKGPCYECLFPITSNQEETHTCNSDGVLGVVPGILGNLQAIETIKIILNKGILLSGFLLVIDFLKMNFFQYKIFKNSKCCKTHCGNNDNNIILYKNSIKNNIKIPEINVFKLSKLIGRKNIKLIDIREEYERKICKIKEDIWIPESQILKYLKNLNKKNKIIIYCRSGIRSSLVVKMILQNGLQNIFNLKGGILQWIDKIDKTLQKY

SEQ ID NO: 364 - protein, 122 aa, Candidatus Endoecteinascidia frumentensis
MRSVSNKNYYNRYLRHFPIIGLKGQKKISQSTILCIGAGGLGCSALQYLTSMGVGKIVIIDYDYIELSNLQRQIIYKEKDIGKEKAVIAAKFCSRRNSFISILSIKKKNYRKKCCSINFKKL

SEQ ID NO: 365 - protein, 191 aa, Candidatus Endoecteinascidia frumentensis
LTYLLGSLNSAIIICRVLKLPSPRSIGSGNPGATNIFRLTNKFSITIYTFLGDCIKSIIPIVIGQYFNLNDTMLWYIGLTAVLGHIFPIFWKFKGGKGVATCLGTLLALNYILGIIFILTWIFILILFNYSSLASIIAIFFTLIFAIFFKLYIYYLIPLTFLFSIIFLRHYKNIKKIFSGKENKLLNKNKI

SEQ ID NO: 366 - protein, 313 aa, Candidatus Endoecteinascidia frumentensis
VDKILKFIWGINNLNIMAKSTIITIGSFDGMHKGHQCLIDNVVLLSQKKKLPSMVIIFEPQPKEYFSKNSTNSRIMTLRDKLIFLKKKKIDYILCIRFNLKFLKKSPEDFVNEILIQKMKCRYLIVGRDFQFGFKRKGNIDFLKKLKNFTIKIVKTQYINKKRISSSWLRECLLNSKFNLASKLLGRNYIITGKIFHGIKLGRKLGFPTININLSKKMVLSGIYYVQVQGIKKYKKIQGIASIGNRPMIKNNDLLLEVYLLDFKDQCYGKLVSVIFLQKIRDEKKFVSFKSMIHQMHIDLKYANYLKNFYIDI

SEQ ID NO: 367 - protein, 951 aa, Candidatus Endoecteinascidia frumentensis
MIIDILIKNFQFLIKITEMSNYKKTLNLPYTDFPMKANLSFKELDFLKDWEKENLYQLIRQSRRKEKKYILHDGPPYANGDIHIGHAINKILKDIIIKYKILDGYDAPYIPGWDCHGLPIELQVEKKYGKSKNKFMDNIFRKKCRIYAQSQVDKQMKSFKRLGILADWKNAYLTMSYQYESKVLYILASIFEKGYIKKGFKPVHWCTKCESALAEAEVEYQEKNSDSIYVKFYIKSIKKISQIFKKNIEIASAIVWTTTPWTLSANLAVAINADINYVLIDIQKKSEKFIIAENLVKSFIQLTKCSSFLILAKCKGYLLENILLKHPFNSYNVPIILGKNIKCDIGTGLVHIAPAHGVEDYKISLEKKIKFQNIVQYNGVFLSDVFLVGGKYYSDANSIIVNFLKKHKKLWYYEKYKHSYPYCWRHNIPLIFLSTPQWFIIMNDKFLTNIAIKEIEKISWIPKWGFNRIKKMIENRPDWCISRQRKWGTPLPLFIHKKTGNLHPNTVQLIRKIASKVAKGGIEAWFESKISDFLEKNDQKKYDIIYDTLDIWLDSGISFHSVLIEKKLPLADLYLEGSDQYRGWFHSSLLSAIATIGTAPYKSVLTHGFIIDENGKKMSKSLGNIVSVEKLVQKYGADILRLWTASIDYRSDIIFSESMIKSTIDIYRKIRNTIRFLLANLKDFCPESDLINTEDMVLIDQWAIEKTLSFQKEIRKLYDSYLFHLVVKKIYEFCSLDMGGFYLDIIKDRQYTCKKFSKIRRSCQSVLYHILEAMVRWITPILSFTANEIWKKIPGKRSVQWVFLDKWYKNLSKIPINSHIQMYEWDFFITLRNIVNQAIENKRKKNEIGSSLDIHVILYLKKEKRILLKKLGKELKFLLITSDVKIKKYNSFVGEKTALEDIKIDIFISNYKKCKRCWHRVKNIGSNIDYYDICGRCVENLFQDGEKRFYV

SEQ ID NO: 368 - protein, 48 aa, Candidatus Endoecteinascidia frumentensis
MYKKSLYWFFSIIILSLDLSSKILVILFLEPYTLHPVIKNFFVFFFNI

SEQ ID NO: 369 - protein, 124 aa, Candidatus Endoecteinascidia frumentensis
LFFFLTFNTGITFSFFSGNNFWMHILLSFLTICILFILSLILIRNKKNIWINIGISMILGGGTGNLINRIAIGSIVDFMTFLYKGYSFFIFNIADIFITLGIIFVILGLINKKNRNEKYFNFYL

SEQ ID NO: 370 - protein, 255 aa, Candidatus Endoecteinascidia frumentensis
MKIYSHKMFSQIFLQDTDTIHSIINFFNPKSGENILEIGPGNGELTKHLLKKCSNIFAIEIDYNLSKKLTNKFKKNIYLYQEDATKFNFSKLHKKKIRIIGNLPYHITSSLLLHIIKYIPYIQDMYFMLQKEIVERIIAKPNNKKFGRLSIIMQYHFKIKKLLYINAKKFFPIPKVDSIFFSLKPYYISPFGKVNTEILSKVTKIAFQKRRKLLTNSLNKNIIKKLKISTFKRPESIHIKDWVKISALYQDLNLL

SEQ ID NO: 371 - protein, 328 aa, Candidatus Endoecteinascidia frumentensis
MKKNHKIVISVGEPSGIGPDIVIKLMKIYANQKINAKLLFIADPKIIYNRAVILGENILIKEKNDFSSIKSNEICIYPIVCPNVIHPGIINPDNSIYVLSCIKKAVKLCQKKIADAMVTCPVHKGFINQSGILFSGHSEFIAKLCNVEHIVMVLTDNIYRIALQTTHIALKDVSSYITKTSLNKKISIIHYSLKKIWSISNPRIGVCGLNPHIGENGYIGSEENSIIRPTIDKLNNYKNFNIFGPISADTMFSEYLKNKYDIILAMYHDQGIAPLKAKSFGKIINITLGLPFIRTSVDHGTALKLVGTKYVNINSLLESIKLANFLIK

SEQ ID NO: 372 - protein, 443 aa, Candidatus Endoecteinascidia frumentensis
MSGIFNKKKIIFLLLTIFVFINNTKSLAFDNLLIEDDTKNIEKNITDEKNAKIVNEIAAIVNGNIITSYQLDNAIKTYYLFHKKNKINILMIQKNILKNLILLEIYTQIAITKNIIATKIDIKNMIENIAKKNNLSSIDMINLIKKNGINYNLYKENLRKQILMFKLEQKISNTIIIKPYEINLYLQNLINKCIPNNNLYLISHILISFSKNQSNENKKQLYHKSKFIFENIKNNNISFFNAAKKYSDSIDSSSGGFLSWKKLDEFPQDFIPILNKMQIGSIYGPFKIGKGFHILKLIAKKKIYPISYLYNEYYIQKTIIPIDSGKELQKIFYKSISQYNKKLSSNKKIKKITYWISINNINKKILNIINNLKVGEISQPLKVNNYWIIIKLLKIKSKDVDLNFLKNQSIKDIFQKKLFNSLKEWNIKIQNDSYIKILKPSLI

SEQ ID NO: 373 - protein, 270 aa, Candidatus Endoecteinascidia frumentensis
MIGKILGGFFGFLLFGTIGSLIGIVFGHFFDKNRSIHILYSKKNMNIFYRSLFSTIGKYSKIFKIFIDFMFIEQIIKNIGLNSIEKKYAIKYLEKGKKDDFNIFDFLNEFKNIFIQNGKLQKTFIDILLEIAFLNGNPSSEEKNFLLKIAKKIGIHEEKFRAIFFTFSYKEQFHSGWNFYSEYYYNNDHGSKPYNEINKHELIEQAYSILGISPTNDIYEIKKTYLKLMKQHHPDKLIAKGFSEEAIKKTTKKVQKIRESYEILKKHCKK

SEQ ID NO: 374 - protein, 229 aa, Candidatus Endoecteinascidia frumentensis
MHKNIKYNSFCICPSILSANLATLGEDVNRVILAGADRIHIDVMDNHYVPNLTFGPIICKSLIKFGIKIPIDIHLMAKPVELLIKRSIEAGANGIIFHPECSQNVDKSLDLIKRANCQSALAINPATSLNSIIDFLDKCDKIVLMAVNPGFENQKFIPETFNKIKKLKILLQNFKKYKNIPIEIDGGVKYQNIKKIANFGVNSFVIGSEIFHNKNYHHIMKKLRKKLEN

SEQ ID NO: 375 - protein, 128 aa, Candidatus Endoecteinascidia frumentensis
MKFKDFIKKFYCFNKILTPSIIYFIFGFFVIISIILGMNDIIDSFGYTYNIEIGLLYKRGNFLLFLLGTIKIIIGTILSKVFCELILIFFENRKHLKKISKNIDKILKKNKKLYLEKNIINKKDTENI

SEQ ID NO: 376 - protein, 213 aa, Candidatus Endoecteinascidia frumentensis
MFNFIDKILIEIGQAITSINTNSNINLKEEINENQNKKIRKFNKKQLKHISGLMRVNHCGEICAQALYRGQAFFLKNKKLKKYLYRTAIEENDHLILFHKRLKDLQSYPTLLNPFFYIFSFNIGVLTSFFGKKIILGFIQETEKQVVQHLDNHIKQILYIQDYISYKILKKIKDDEIYHAKKASYIEEYKLPSIICSLMKYLSKIMTIVTYYI

SEQ ID NO: 377 - protein, 621 aa, Candidatus Endoecteinascidia frumentensis
MSEIIQTNKISYIHNLIALGKKQGYLTFTEINDHIPNEISDPEHIETIINLLNDVNINVLENPPNTDDFFVSENNDDEYLAEEAAALVTIDGELGRTTDPVRMYMREMGKVELLTREGEIKIAKRIEEGTVQVLQAIISYPAIIGHIINIYESIILKEEKEDLYNIVSSLNSSDDIEMVSGDFGSLLNIQNKKKEINNCFFSSKEKKDNTLPSKTKLDELINFFEKLKILHENFLFTQKKKNINFEKYKKAKSDLSECFLKAKLTTSQFNAITKSLRKSLSDIRKYEHMIMKYCVKYGGMNKKIFIKSFSKNATNLYWLENLIFKYPKLKETISVYKDDIINIQRKIRYTEKRSLLSIFDLKSLNKKMAIGEAKTRCAKKEMVEANLRLVISIAKKYTNRGLQFLDLIQEGNIGLMKAVDKFEYRRGYKFSTYATWWIRQAITRSIADQARTIRIPVHMIETINKLNRITRKIVQNNGKEPSPEELAKHIDIPEEKIRSVMKIAKEPISMESPIGDEEDSNLGDFLEDVNSVSPIDFTTYQNLRETTRKILSGLTLRESKVLRMRFGIDMNTDHTLEEVGKQFDVTRERIRQIEAKALRKLRHPSRSEALKTFLDKNKEDV

SEQ ID NO: 378 - protein, 296 aa, Candidatus Endoecteinascidia frumentensis
MYQLSKKIIFCFDGDESGRKAIWKILNIILPTMDGNYEILFLFFPKEYDPDSYLRKFGKKMFKILINNAIPLSNFLIKSFFSQNIYLSLDKKAKILNKIIPIIKLIPKGSFLIFILESLSTKITIHIDILYKIIYEDFSYFVNKKSIKINPIQRAIAYLIQNPKLGRYINIPKIEIQKKEKDLYLFQNLCSFLKKNIISNNEDFLSIFMKDKNEICIKKEEKDLFAQLSNVELPLKKLKDIKYEIENICTKFYTYSNKIKLEQLIIKSKSNKLSEIEKKQFFQIIKKKANRFEIKK

SEQ ID NO: 379 - protein, 105 aa, Candidatus Endoecteinascidia frumentensis
MRFLLIKRGENYIACCPFHNEKTPSFTVSEVKQFYYCFGCGKHGNVIHFIMKYDHISFFEAVIQIANILHLKIPRNKKFYIQERLYQEKKKFISLFRKNKKIISF

SEQ ID NO: 380 - protein, 71 aa, Candidatus Endoecteinascidia frumentensis
MPIIRVKDTEPFDVTLRRFKRSCEKAGIISDIRKHEFYEKPTAKRKREKSAAIKRQIKKLKREKQSKRKYY

SEQ ID NO: 381 - protein, 264 aa, Candidatus Endoecteinascidia frumentensis
MQQYLSLIKDVLVKGNYKNDRTKIGIKSIFGRQMRFDLSKGYPLVTTKKCYIKSIIFELLWFLNGDTNIKFLQKNGVSIWNKWADKNGNLGPIYGKQWCSWNGLNGKTINQIEDLIWNINNNPNSRRLIVSAWNVSELSYMALMPCHIIFQFYIYNNKLSCQLYQRSCDVFLGLPFNIASYSLLTLMIAQQCNLEIGEFIWTGGDIHIYNNHIQQAYTQISRTPYTLPKIKILRKPKTIFEYQYEDFQLINYQHHPPIKAPIAV

SEQ ID NO: 382 - protein, 162 aa, Candidatus Endoecteinascidia frumentensis
MINISIIAAISYNYIIGKNNSIPWYLSNDMKFFKKVTLGKNVLMGRKTFDSIGNKALPGRNMIILSHYKKFYSNCIYITNIKTFMKNYQNQDIIIAGGSQIYRIFMPIATTLYITKVECYIDGDAKFPKFSLKEWNEISKKRFMCNLKNEYSHTFHVYKRKK

SEQ ID NO: 383 - protein, 56 aa, Candidatus Endoecteinascidia frumentensis
MAKKGKREKIKLNSTSGTGHFYTTTKNKLNTSQKIKIKKFDPRLRSHTLYEEGKIK

SEQ ID NO: 384 - protein, 76 aa, Candidatus Endoecteinascidia frumentensis
MARICQITNKRPIIGNHVSHANNKTKRKFFPNLHTHRFWINSEKRYIKLRITKKGIRIIDKYGIEKMFTLFNKKLR

SEQ ID NO: 385 - protein, 160 aa, Candidatus Endoecteinascidia frumentensis
LEINIFFSKIFVKKIKNDMKPLYTNSQLEIIETFSFFDDWHQKYEYLISLGKKIKFPIEEKKDFNLIKGCESQVWMISYHKNEKLFFNGISDSVIVSGLIAILLKIYSGQRAKDILNMSLDFIKKIDLATHLSPNRKNGLFEMINSIKKTAYKNYILYYQ

SEQ ID NO: 386 - protein, 90 aa, Candidatus Endoecteinascidia frumentensis
MVFTFSTEGQCYTSTRRLLIHKDLYKYIIENLVDAYKKIKIGDYINSNNHMCPLIDQDAVNKYISAIQDIKNTGGKFYMKEILFLEKVFY

SEQ ID NO: 387 - protein, 31 aa, Candidatus Endoecteinascidia frumentensis
LINKFDKVERAKMLIDTLPLNISNILQYVTI

SEQ ID NO: 388 - protein, 145 aa, Candidatus Endoecteinascidia frumentensis
MKNRKIYKNSKRMEVKIISFNQGIFFKNQAKSLSLRGDNGDIGIFPGHLHLLTKFCLSFIYLELENIEEFFFASEGILQVHPENVIIIVNTIENLKNLDIDLLKKEKILKESIIKKTKEKTKKLKLYKKILEINMKLHIFTYYKK

SEQ ID NO: 389 - protein, 469 aa, Candidatus Endoecteinascidia frumentensis
MDTEYNQNNTKVIGKIIQIIGPIIDVQFQNNKQSCIYDALRVLKTGLILEIQQLIGNGVVRSIAMGAIDGLQKGLEVENTRSPIKVPVGHNTLGRIINVLGEPIDNKGKIKNAKYMPIHFKPPSFTEQSLEIKLLETGIKVIDLICPFSKGAKIGLFGGAGVGKTVTMMELINNIAIEHNGYSVFVGVGERIREGYDFYQEVQSSNVLNKVVLVYGQMNEPPGNRLRVALTGLTIAEGFRNEGKDILLFIDNIYRYTLAGTEVSALLGRIPSAVGYQPNLAEEIGLLQERIASTNKGSITSIQAIYVPADDLTDPSPATIFSHLDATIVLSRNIAELGIYPAIDPLDSTSRLLDPMIVGQDHYDTKNQVQKILQKYKDLKDIIAILGFDELSEEDKFVVSRARKIQRFLSQPFSVAEIFTGKSGKYVPLQTTIQDLKGILEGQYDYIPEKFFYMIGSINEAVKNFQNEK

SEQ ID NO: 390 - protein, 290 aa, Candidatus Endoecteinascidia frumentensis
MISTKEIKLNILSIQNTRKITHAMELISANKMNKIYHNLLHIIRPYSTSFTEVIENILSAHLEYQHPFLKKRNIKNIGFVVISTDRGLCGNLNFQIFKLLKKKIQIFKEKKINSYLLIIGEKAKEFFFSYEDSLFYKINFNNIPKIEDIQNLVNTIFDYFNKEKVDEIYILYNKFYNVMKHVPIYKRILPIQINQKKEIYKKEKSYWDYIYEGNPKLLLEFIFSKYIYSQIYHSIIENLMCEHAARMLSMKNATENADEIINNLKLQYNKCRQFTITKELAEIISGSESI

SEQ ID NO: 391 - protein, 514 aa, Candidatus Endoecteinascidia frumentensis
MNLSSSEISDLIKKRIQNFDFTPELQNTGSVISVKDGIVQVYGLENIMYGEVVQFPKKNIFGIALNLQSDFIGIIMLDNKIFPLEGDIVYGSGNVLTVPVGECFLGRVVNALGKTIDGGDIIQEKIFSPIEKNAPEVIFRKSINQPLQTGYASIDTLTPIGKGQRELIIGDRQTGKTTIGIDTIINQKNKNVKCIYVAIGQKLSSIANIVQVLKDYDAMKYTIVVSASASESAAMQFIAPFSGCTMGEYFRDKGEDALIVYDDLTKQAWAYRQISLLLRRPPGREAYPGDIFYLHSRLLERAACVNSEYIKERSCGKIQKKSGSLTALPIIETQAGDISGFISTNVISITDGQIYLETNLFNSGFRPAINSSSSVSRVGGSAQTKIIKKLGSAIKLSLAQFRELEAFSQFSSNLDSMVKKQITYGKKMMELMKQKQHNLLSISEMAILFFAIENGYLNSIEVNDIQHFKTSLINFFKNQYSTIFHKIEISGNYCDSIAQDLKKIILEFQKIYIP

SEQ ID NO: 392 - protein, 177 aa, Candidatus Endoecteinascidia frumentensis
MSFTSNISISYAKSIYELAVENKNILSWKEMMQNISYFFTKKIVQKYIYSSVFLFKELIDFFSETYFLTKYQKNFMKILYKNGHLYIFPNIYYYFEKYYINDISHIQSGTVYSTYSLKEIHIKDLEKIINKKLGISIKLINKINQKIIGGIFIQIGNKIIDISTKYKLKCLYTNLLK

SEQ ID NO: 393 - protein, 137 aa, Candidatus Endoecteinascidia frumentensis
MKYIWPPLVNALKIRRKKIANGIKAASLAETKLKKAQDESCLIIQKAKNQANNILNNANIDANKIINLSKKKGHNIIKEMKLLATNQIQQEKLKVKRELHKEFVSVIFDILQKLLCNNTNFSKKIFIQDIIKEIKDI

SEQ ID NO: 394 - protein, 99 aa, Candidatus Endoecteinascidia frumentensis
MQISGQIIANIESATAIAAALLIGLSALGTAIGFGILGGKFLEGVSRQPELTGLLMTRMFLMAGLIDAFSAISIAMGLMLLFGSNPLLNTVISHLNISK

SEQ ID NO: 395 - protein, 264 aa, Candidatus Endoecteinascidia frumentensis
LIKTHINSDIYIQHHLLHWMFNFHSMKFEQSNNFFSINLDTLIISIFLGLCFLGIFYYGVYNATSKTPGMLQNFIELSFETVENIIENSFSFRKRKYFIICLAITIFFWIFLMNFMDLIPVDFLPNIMSIFKVSTFKSVPTADPMLTFALSLIVFFLTIYFHFSEKNIRKILQDFLIHPFGIYFFPINIIFCLIENLVKPLSLALRLFGNMLASELVFFLIALLPWWIQWLPGSIWSVFHILVITIQSFIFTMLTIVYLNMAQE

SEQ ID NO: 396 - protein, 122 aa, Candidatus Endoecteinascidia frumentensis
VQFPSYYLVLIQFLFSIFFTVIFGIFLGKKTVFSIFSGSCTIFLANIYTVFCFLIKKNNNIYSKNTTFFLCKIFFGKYIIIGILGYLFIKLSNLDWKLFLIGILIMQFSFFLIFILQKFIHK

SEQ ID NO: 397 - protein, 215 aa, Candidatus Endoecteinascidia frumentensis
MSICWIQGKVGKIEIAVNNVKKIDEKNKLIVFLMCSPHPLFQGTMENKVVTTVVRLCKKMGISSVRFNYRGIGKSEGKYGNIYGEIDDTISVLFWIKKNYPSYQIWLGGFSFGASIAYRVSILFPIDQLFTISPNITNSTYNSILETNVPWTVIHNDDDEIIDTKNVLKWIINHKISFHLIRLKGVSHFFHGKLIQLQNILSPIFKKKLKKLCHF

SEQ ID NO: 398 - protein, 348 aa, Candidatus Endoecteinascidia frumentensis
MSFLKYYLNVCKNKIQKDSSQYRLVKKLEPVWFHLVKRKKIFFYNFFQSKKKNKGIYIWGNVGVGKTFIMDLFYESLPFSTKRRFHYNRFIQKIHKELISIEKNKNTIERVIQKICKNILLFCFDEFFLNDISDTFFLEKLFKFLFRKNIYFILTSNIKPNFLYKGGIQKEKILPIITEINKNMHVIQIKNTIDYRTSKNSLKIKKTKFQERYMYKYFLNLEKEFTKNIPLIISGRKIKTLRIGKISVWFDFFDICILPTNLYDYIEISNRFTNIFISNIPKMKDDMNDCARRFITLVDEMYNSKNNLFISTMVSINDMYVGNDLSFEFQRTTSRLIEMQAKKIFTLK

SEQ ID NO: 399 - protein, 299 aa, Candidatus Endoecteinascidia frumentensis
MKFQTLFLLGATATGKTKLAIEWASRYPIEIISVDSTMVYRGLNIGTGKPKEKILSKIPHHLINLCDPTKIYSVALFIKDAFNAIKIIRNRGRIPLLVGGSMMYFKYLLKGLSDLPIANYSIRKKILEEGEKNGWKIMHKKLKRIDPESYSRINFNDKKRIQRALEVYSITGCSISQIWKNKKGICYPYSYKILGIPVEDRVLLHKSISIRFHNMLKAGFLEEAENLYRRYDLHESLPSMQSVGYKQAWQVFSGKLPLKYLSEKSIIATRQLAKRQLSWLRKWKNIYWIKKRNDINLYI

SEQ ID NO: 400 - protein, 72 aa, Candidatus Endoecteinascidia frumentensis
MIRPQRKKNKEHQNLLASLKKGDEIVTTGGIFGKIKNLNDKIIELEVNNGIFIKIQRQSVINLFPKGTIFFN

SEQ ID NO: 401 - protein, 621 aa, Candidatus Endoecteinascidia frumentensis
MVSNQNYLFPISIGKKIYYFFILFIIFIACLYALPNFFREYPSLQISPKEGKIMSIKNMQRIMSTLKKCKISYKKILYSHYILEIVFTNTNLQIQAKKLIKNFLKNNYSVAIHMYSDIPYWLKIFHAHPIKYGLDLRGGVYFLIDINTNVVIKNYLTREIEKLEKNLYNENIYFKHMEINNNKIIIESDNIKSIDRIKKLISHKFPNLLFNQNFFQEKNKIQLVVSPNILLMISKSAIDQTIEVMRNRVDELGVSEASVSKEGNTKIAIEIPGLQDAVQAKEVIGGTSSIKFMLVDNNAILSESPKRSIYYFLSPIGEKSFFVLKNQIVLNGKSIIDAQVNYSEDNNLPVVNIRISGEEVSKFSDITEKNIGKQMAIVLIHNNFNKSKFDTDERIISIATIQQKLGDSFQISGLNNIREARILALNIRSGSLPAPIKIVQSKQIGPSLGIENIRMGKISIYISMLLITIFMVIYYHAFGIIANISLLLNLIFIIAIMSIIPNTTLTLSGLAGIVLNIGMNIDSNVLIFERIREEINKGNFLQKAIHIGYQRTNITIIDSNLTTLIVSFILFTIGTGSIKGFSITIMIGILSSMFTVLIVTRILINYFVSKKMILRYLSIGI

SEQ ID NO: 402 - protein, 313 aa, Candidatus Endoecteinascidia frumentensis
MEFFKKTNINFLGFQRIAIFFSIILSIFSVFFIIYKGINWGLDFTGGYAIEIHLNSDFSNDQIQRLKNKFSTISGIEHIKIVTFGGEKDLRISIQTTDMDTKSNKKIPLKIIKSIKKVFKKYGKILSVNYIGPEIGKDLMKKGFLAILISLFAMMFYISIRFTIQFSIGSIIALAHDPLIIFGFFSFFQIPFDLNTLAAILAVIGYSLNDTVVIYDRIREKFKNFYSRTTKSIVLKIVNQAINETLSRTIITSGLTLSVLLVLYFLGGETLYGFSLALIIGVIIGTYSSIYIASALAITISLKKIIRNKEKIL

SEQ ID NO: 403 - protein, 429 aa, Candidatus Endoecteinascidia frumentensis
MINIKKLDKDPNKIIKNLKKRNFSIDFSQLISLRNKLQKSKNENQYLQRKHNEISKKNSFSCKKEDNQSLFKEAYLLSQKIKKNNKNISFLQIQLNKYISTIPNLLDSDVPEGKNESDNIIIYCWGNPKKFDFIPMNHIQLSHSIKGIDLKTSSKLSGSRFSIMKGEIAELYRAIIQFMMDVHIYDNGYVEVYIPYLVKKHCLFGTGQLPKFHKDYFYIQGDSNLVLIPTSEVSLINIASNTIYSDKDLPIKMVAFSPCFRKEAGSYGKSTYGIMRQHQFDKVELVQLVKSENSDFALHSLTKNAEKILQKLELPYRLTKLCSGNTGFSASKTYDLEVWIPSQNKYKEISSCSNCRDFQSRRIKARWKNKKTGKIELLHTLNGSGLAVGRTLIAIMENYQNIDGNILIPKVLQSYMKGKTIIQLSNSRS

SEQ ID NO: 404 - protein, 260 aa, Candidatus Endoecteinascidia frumentensis
MGFLKGKKILVTGIMSNRSIAFGIAKAIHREGGKMVFTYVNKKFKDRISKLVKIFNPVSILPCDVSSDNQINNLFDMLKEYWENFDGIIHSIAFAPMDQLEGDFLSNITREGFLTAHEISSYSLCAIAKSAKNMMKKSPSSIVALTYLGSQKTVVNYNTMGLAKASLESSIRYISQSLGPDNIRINAISSGPIRTLAASGISGFRKILDYNAKISPLRRNVTIEEIGNIAAFLSSDLSSAITGEIIYADCGFNTIGVANL

SEQ ID NO: 405 - protein, 296 aa, Candidatus Endoecteinascidia frumentensis
MIYISTCHDPFINLAIEDWLLNQKKSNQTLFLWQNFPCIVIGRAQNPWIECNLKEMQRNNIPLVRRQSGGGAVYHDLGNLNITIFSAIKEHSIIKNLDFISKIINTLGIKLISNERNDLIVHYNSNNYKVSGSAFRHVKDYAFQHLTLLVNCNLKNLKKYLKPFNKGIISKGIKSIISPVINLNQIEPNLNISKIQDALISFAKLDSKKKIIKISAKKYKINKKKFVTWEWCFGKTPPFVQKIKNFDAKKIVIYVEKGIITDIKSNEISEKHLNKIKYKFLCKRYCIKNIKNIKNY

SEQ ID NO: 406 - protein, 339 aa, Candidatus Endoecteinascidia frumentensis
MSDVVLLTVENVVSLVKKIGISQCFKRLNFQLKYDFSNWEKYQLSPRHATHFSDGVIELMPFSNEKYYSFKYVNGHPINTKKNKQCVFAFGALSKISDGYPLMISEMSLLTALRTAATSALASHYLTKPNVKIMGIIGTGAQSEFQALSHHFLLGIETIRYFDIDPFAMHKFSENLKKYPIKLIACSSIEEVVNESEIITTLTADKSCNKILTNSMIQPGVHINAVGGDCPGKVELDPKILERSKVIVEYTKQSRIEGEIQNSPNTDPYAELWEIITGNKIARSSNDDITIFDSVGIGMEDFSVLLCFYELSKEYNIGNTISIIPKLEKNIKNLFSLLR

SEQ ID NO: 407 - protein, 205 aa, Candidatus Endoecteinascidia frumentensis
MVYCIGLTGFISSGKSTVANFFSEKNISIIDTDQIVKKLIKKKTFFWRKIIQNFGTSILEDNQEINRIQLRNIIFHNFQKRIWIENLLHPFVRKITNKRINNNKSIYCIIAIPLLNKKKLLEYPINRVLCVLSTFEKQIRRFLMNQNNNKKIFKKIINSQPSIKEKLEISNDILLNITSKNQLKSDTLILHKKYLEYAKIFKKNI

SEQ ID NO: 408 - protein, 31 aa, Candidatus Endoecteinascidia frumentensis
MKSILKKNKFYDLYHNYKDTLYGCSKIFSII

SEQ ID NO: 409 - protein, 261 aa, Candidatus Endoecteinascidia frumentensis
MDVQKFFQLYKNNTKIVMTTCYDFLFAKIISKTNIDAVLVGDSVAMVYHGYPSTIYATMDMMIMHTKAVANGIKKKIIIADLPFLSYRKNLILTMNAVESLIKAGANAIKLEGINGNEKIIRYIVNSGIPVMGHLGLTPQFINQFGGYKIQGRDKKASYKLITESKIAEDIGCFSIVLECIPSKLANIITKKISIPTIGIGAGKNTSGQILVLSDILGMTPEFNTKFIKSYLNGYDKIQKVIENYVLEVKKMVFPSKENSY

SEQ ID NO: 410 - protein, 252 aa, Candidatus Endoecteinascidia frumentensis
MIVIRDLLKWKIYRKLISSKKKIGVVMTMGCLHIAHEYMINKSIQENDITIVTIFINPTQFNCNYDLQGYPIKIKKDLKISKSLGVAYVLLPRYSEMYPERYSYRITEDKFSKKLEGKYRLYFFSGVLTIVMKFLNLIKPNNAYFGEKDFQQFILIKEMVKAFFLEVNIIFCPTIRENTGLAASSRNVLLSKKGLDLAKKLYFILKKYNSSQECYFQLKKLGLHVEYVKDYNKRRYAAIYIEGVRLIDNIKI

SEQ ID NO: 411 - protein, 279 aa, Candidatus Endoecteinascidia frumentensis
MKINWFPGHMNKSQKNIKKLFKNIDICLEILDARIISASQNPIFNSWKIKNKTIKIINKIDLADPIITKKWIFKFKKEKMSVLSINKNFKNISKYILHKINNILIKKGNIVNPIKIIVIGIPNVGKSSIINQLVKKKICQVANIASVTRNIKEVKFKKGKILIYDTPGVMWTGKSCKEEYGYHLALCTAIKNIAFKYIDITIFLINHLKRYYSNCLKKKYGIQNFLKDSEDIIKEIGKNQNLISCNKNVSNIFILDKISRRIIQDFQSSKLGRISLDII

SEQ ID NO: 412 - protein, 461 aa, Candidatus Endoecteinascidia frumentensis
MIFKKKITVFSLIMLNVIAVDSLRSIPFAAKYGFSLVFFYLIGALCFFIPTALVSAELSTGWPEQGGIYIWTKKAFGKKWGMIAIWIQWVYNIVWFPVILSLISTTIAYIINPSLIYNKNFIAFMVLFIFSGTTILNSYGIYASYRLTNISAILGSIFPIIIIAIIGSMWIYDGKPSQIKFDWNHFFPHISSIGSLVLLTNVLFSLVGIEMSSIHIKDVENPKKSYPKALFWSSFIILITLIGGSLSIAVVLPKDKIELLSGMLQILDAFCSSYHIKYIKYIIPICIILGGIGSISAWILGPSKGIMVSSKDGIIPKFLSKCNKYNAPVGVLRVQFLIFLFIWSIYWFMPNVSSSFWILSNITAILSFIPYIFIFLSIIFLRYKFPNIKRAYKIPGGILGVSIISFLGIITCLITIIIGFIPPDGIDYGSLWRYELILCFGIFILLIIPFVYNFIKIRIKV

SEQ ID NO: 413 - protein, 258 aa, Candidatus Endoecteinascidia frumentensis
MNKRECINALLALIEKESARWIRTWIQCLVPPAISITLYFLIFGHIIGSNIGNMNGIPYLSYLLPGLVMLPIITNSYGNVVHSIFVSKMLHHIEELWVSPMSTFLIVLGYQFGGILRGIVTGIIVLSIGIICSKATIIHPIITVFTMFSCAALFSLIGMINGIMAKTFDDSTIITTFILTPLIYLGGVFYSLDRLPKIWHTISQFNPIYYIVELFRYATIGNFMNDSYYKLLGVIWSLIIIAFFICWGILNSGKWTKP

SEQ ID NO: 414 - protein, 313 aa, Candidatus Endoecteinascidia frumentensis
MNSFNAIEISKLNKTYRNGIVALKNINLTIKSGSFFGLLGLNGAGKSTLIGIISSLIIPGDGDIKLMGYNLRNETSFAKKNIGVVPQESNLNNFEKCRVIIRNQGRFYGLPRRMANQKTDELLKMVGLWDKRNKISNDLSGGMKRRLMIARALIHNPKLLILDEPTAGVDVEIRKIMWNMLKNLNKQGMTILLTTHYLEEAQTLCKELAIIHKGEIIKHESTKNLLHRLNSKLFTLHLKEPLSKKNLYIKEFSIKKINDMTLKVIIRKNQNISNLINKLQEYNILIQDISVPSNQLELIFTDILSEKYGENNE

SEQ ID NO: 415 - protein, 364 aa, Candidatus Endoecteinascidia frumentensis
MNTLYKYICYLLKKNQNWIPFDRFLKIALYTPKIGYYTKKNIRNKDYITAPIMGHILGKCIAYHFIPILENLSKDAIILEIGAKDITLAIAILSLLEKKNRLPKEYWILEINKYFREEQKKILNTNFPNFKKRIIWIDKLPSYKFEGIILGNEFLDSIPFKRFEIYQSNIFELGVSKKNKENLFIWNRSIIKQKFWQKKINRYFLPDGYRSEMHFLYYKYFKKLLFNLNEGYVLWIDYGYSKNIYYHPERKDGTLSCYYKHKFHNNPFQYIGNQDITSHVNFSEIASSLKKMKFIIIGFTTQTNFLLQNGLMNLQSKKISLSLSCELKKLLLPNYMGDIFKFLGAYKGKKLQNLKSWNVKQLNL

SEQ ID NO: 416 - protein, 127 aa, Candidatus Endoecteinascidia frumentensis
MQNLHNKNYISLLGIKTKTSIGLYKWERRRKRSIIIDIKMALSEKKIFIKDDLNLTLNYQSIIKLILKICKNGNFKLLETLAENIIYNIFKHFKKKLISIEITIHKPKVFLIVKDISVTLKRYEYIV

SEQ ID NO: 417 - protein, 91 aa, Candidatus Endoecteinascidia frumentensis
LKKEHIIQKIKLCIPDAKVFIFSEDNIHYTLIVISDSFVKETRLQQQQKVYSSLQKQIKSGEIHAISLKTYTYKKWADQQDNYSKIEKKCI

SEQ ID NO: 418 - protein, 315 aa, Candidatus Endoecteinascidia frumentensis
MQFLEFEKPIIEIEEKIKALKKIQEYESHINLFNDIKKLEKKKNDKIKKIFFNLNEWQMIQMARHPMRPYAIDYIERSFTDFQELRGDRVFQNDTAIIAGLARINKEPVMVIGQQKGRTTKEKIYRNFGMPHPEGYRKSLRLMKLAERFKLPVITLIDTPGAYPGIQAEERGQSIAIANNLISMVKLKIPIINLIIGEGCSGGALGIGVGDRLLMMQYSYFAAISPEGCATILWKDIKKAPKAAKKMGITPNRLFKNKLVDFIIKEPLGGANRNYQKTADKVKKILFQEIKTLNKLTIHQLLNQRYERIMNFGIS

SEQ ID NO: 419 - protein, 419 aa, Candidatus Endoecteinascidia frumentensis
MSNLSTKEIFQSLKKISNIFPNKNWVIAYSGGIDSTVLLHAACQISKKIRAIHIDHRFNENSKLWAKHCINFARKLKILCNSYKLQNYKILGCKNQEIFGRKERYRIFAKKIQSNEILLMAHQLNDQAETIFLNLMRGSGILGISGIPIKRNLGNSLLYRPFLNIEKYKIQEYAKIKKLSWIEDPSNKNIHFNRNYVRNVILPHFLKRWPNTLFAINQSSKYCRDSYLLIQSHINSLIKNKNKNLSSLSITWIQTFSKIYQDSIIRIWFSSVTNTVLPRKSLKHIYLNILQAKKDSNPLLKIGKWNIRRYKKYIYIVKYTKTSSNINYCIPWNGKNGIKIPGLSIMLFSNDISHLIDCKKLKWSNVSIRNRINVKNSLNIKSKKLKKIYQKMSIPPWERDTTPLLFENKQLKIAISIKK

SEQ ID NO: 420 - protein, 246 aa, Candidatus Endoecteinascidia frumentensis
  MISC_FEATURE: EtuO2 (Flavodoxin reductase)
MTIQKISLMLVEKSMITLSVMNCKFRYEKNQFLNFIPGQFITFLINTPEGKIKRRSYSVSRIQKKSRIIEIAISIIHGGFASEIFLNIKIGAFFNAIGPIGKLILKKSININRYILIGTGTGIAPYRSMLSDLALYCQNGIKINIFEGVQYKKDILYKKDFILFDKKYQNFNFLSCLSQENIKNIGKYERCGRIQKQLIKLNLNPEKDMIYLCGNPNMIDNIFLILIKKYKFHSNKIQREKYISIK

SEQ ID NO: 421 - protein, 455 aa, Candidatus Endoecteinascidia frumentensis
  misc_feature: EtuP3 (Pyruvate dehydrogenase-E3 Component)
  misc_feature (131)..(131): Xaa can be any naturally occurring amino acid
MVNSFDYLVIGSGSGGISSAIQASKYNVKVGIIEGSKNLGGTCVNHGCVPKKIMYFGSMLSSMLHESINYGFSFQKKNINFSWEKLIKNRNTYIKNIHNFYKKKITDNNIKLIQGYAKFKNNKHIIVNDMXYTGKYILLSPGSSPKIPNIYGAEYGITSDDFFKLHKKPKRVVIVGSGYIALEIACMLHALGSQITLIIRYKNFLRKFDDILGGTLMEILKKKISVIPQNKIIQVKKNNTENLTIYLQNKISISNIDCLIWAIGRSPNIAHLNLKNTDICLKNSAIQINKYEQTTVKNIYALGDVTNTYNLTPVALKRGRYLSQRLFNQENIYINYKYVPTIIFTHPPLASVGYSEKFAISKYGKENIKIYTTSFKSMYDTLAMNNIKTAMKLICLGDKEEVIGCHIIGLNCDEMLQGITIAMNIGATKKDFDHTIAIHPTISEELVTMKLRENC

SEQ ID NO: 422 - DNA, 1017 bp, Candidatus Endoecteinascidia frumentensis
  misc_feature: EtuF4 polynucleotide sequence
  misc_feature: EtuF4 (birA, biotin-[acetyl-CoA-carboxylase] ligase region)
atgattaatttaaaaaaattaacaattttaaaagaaatattaatttttataagtcaaaaacaaaaaatcttagtttcggaagttttaaaaaaaaaaaaaattagtaaatttactcttttaaaatatataaaatatatgcaaacatttatggctattgatataaaaattattttaaataaaatttatgtttttccaggtccttattttcctttaaaccaaaaagttattatgaataaattaaatatgaaatcattaaattttattaagaatattatatgttatgattgtgtaagttctactaataaaattatatataaaataatgaatatgaataaaaaaaagtatggaatatgcataagtgaaatgcaaacttttgggataggatctagatataaaatatggcaatcaccttttggttataatatatatatatccattttatggacctttaaatattctatgctttctaaaatatctattttaaatattcttgtagcaatagtaagtgtaaaaattctacaaaaatataaagttggaaaatatattaaaattaaatggccaaatgatatattttataatgatcaaaaaattggaggtattcttatagaacgatattttgataaaaataaaatgataaaatgtataattggaattggaataaatggatatttatcaaattttcttaaaaagaaaatcttacaaaatagtacctcattttttgaagaaaccggtaaaattctagatagaaatagttttattgctgatttaatcaatcagctaatatctgatttaggaaattttaaatatcaagaattattttttttattaaatgaatggaaaaaatttgattttttttataaaaaaaaaattatatttacatcttcacatcatactatcgaaggaattggaatggggattgcaaataatggattatatttgataaaaaatagtaagaaccaaataataaaattatttcattatcctggaaaaactaaaattcatttgcatacttcctaa

SEQ ID NO: 423 - protein, 338 aa, Candidatus Endoecteinascidia frumentensis; identical to SEQ ID NO: 356
  MISC_FEATURE: EtuF4 amino acid sequence
  MISC_FEATURE: EtuF4 (birA, biotin-[acetyl-CoA-carboxylase] ligase region)

SEQ ID NO: 424 - DNA, 450 bp, Candidatus Endoecteinascidia frumentensis
  misc_feature: EtuF5 polynucleotide sequence
  misc_feature: EtuF5 (3-hydroxyacyl-[acyl-carrier-protein]dehydratase)
atgaaattaaatattaattatattttaagtttcctacctcatcgttatccatttattatggtagatcgtgttttaaatttagttcccaaaaaatatataaaaacattaaaaaatattactgttaatgagcctttttttcagggacattttccgtcaaatcctgtcatgccaggagttttgcaattagaatctattgcccaatcattaggaatattaatatatcatgattttcataaaaaaaataaacctaaaaaaggagatatattttattttattggtattaataacactcgttttaaaaaacctgttattcctggtgatcaattaattatggatattacattaaaaaaacaaaaacaaagaatttatatagcagaaggaatagcaaaagttgaagaaagtatttcttgtaaaactgaaattatgatcttttataaagaaggatattaa

SEQ ID NO: 425 - protein, 149 aa, Candidatus Endoecteinascidia frumentensis; identical to SEQ ID NO: 360
  MISC_FEATURE: EtuF5 amino acid sequence
  MISC_FEATURE: EtuF5 (3-hydroxyacyl-[acyl-carrier-protein]dehydratase)

SEQ ID NO: 426 - DNA, 1032 bp, Candidatus Endoecteinascidia frumentensis
  misc_feature: EtuF6 polynucleotide sequence
  misc_feature: EtuF6 (phosphate:acyl-[acyl carrier protein] acyltransferase)
ttgtcaccgattacaatttctattgatgctataggaggagataatggattaaaggtaacaatacctgcttcaattttagctattaaaaaatatacgaatctttctgttatattggtagggaataaagaaactatttttcaaaatttaaagaaaataaatatgcataatcatcctcgtatttctatttgtcatgctgaacaagtagtggatatgaacgaatctcctgttttagcaatacgaaataaaaaagaatcttctatgcgtatagctattaatttattagatcaaaacaaagcatctgcttgtgttagtgctggaaatactggtgctttaatggcaattgcgaagtttgtattgcaaactgtaccgggaattaaaagaccagctattatttcctccatgccatctataaatgaaaaaacccaaaaaatagaaaaagtatatatgctagatcttggtgcaaatatttattgttctccaaataatttaatcgaattttctattatggcatcttctttagtatcctctttagataatattaaatatcctagaatttctttgttgaatattggcaaagaagaaaacaaaggtattgaattaattcaaaaaacagcaaaagaattaaaaaaaagaaaagatattaattatattggtttcattgaaggtaaagatctattttttaatagaacagatattatagtatgtgatggttttacaggaaatattgcattaaaaagtattgaaggaacatcaaagttaataagtagcataataaaaaatgttttaaatgaaacaattttaaacaaaattttttccatgatttctttccctattttatggaaaataaaaaaaaagtgcgatattcgattatataatggagcgaattttttaggcttgagaaaggtagttattaaaagtcatggatcatctgatgaaatagcatattttagagctatagaaaaagctattaatgctgtaaaaaaagatattccaaaacaaatttttaattgtattaataataaaattatttaa

SEQ ID NO: 427 - protein, 343 aa, Candidatus Endoecteinascidia frumentensis
  MISC_FEATURE: EtuF6 amino acid sequence
  MISC_FEATURE: EtuF6 (phosphate:acyl-[acyl carrier protein] acyltransferase)
LSPITISIDAIGGDNGLKVTIPASILAIKKYTNLSVILVGNKETIFQNLKKINMHNHPRISICHAEQVVDMNESPVLAIRNKKESSMRIAINLLDQNKASACVSAGNTGALMAIAKFVLQTVPGIKRPAIISSMPSINEKTQKIEKVYMLDLGANIYCSPNNLIEFSIMASSLVSSLDNIKYPRISLLNIGKEENKGIELIQKTAKELKKRKDINYIGFIEGKDLFFNRTDIIVCDGFTGNIALKSIEGTSKLISSIIKNVLNETILNKIFSMISFPILWKIKKKCDIRLYNGANFLGLRKVVIKSHGSSDEIAYFRAIEKAINAVKKDIPKQIFNCINNKII

SEQ ID NO: 428 - DNA, 891 bp, Candidatus Endoecteinascidia frumentensis
  misc_feature: EtuF7 polynucleotide sequence
  misc_feature: EtuF7 (malonyl CoA-acyl carrier protein transacylase)
atgaaaaaaatagcatgggtatttccaggacaaggatctcaatccattggaatgctttccaaatataataaacatacaaaaattataagctattttaataaagctagcaatatattaggttatgatctttgggatatttgtcaaaaagatcaaaaaaaaattcatcaaacaaaatatactcaaccacttttattaacagcaagtatagcaatttcaagaattttagaagaaagaaacgaacaaaaacctgatatattagccggacatagcttaggagaatacagtgcacttttatatgctcaatcattatctttttccgatgctattaaaatagtttcttttagaggtaagtgcatggaagaatctggaaaagataatattggtggtatggctgcaatattaggattaacaagcaaggaagtttttaatatttgtatggatcattctcaaggagaaattttaactccagtaaattttaatactgcagatcaaatagtaatatctggacatatgaatgcaattaaacgtgttattaaaaaatttcattcttttaaaaaagggaaaataattttattgcctgtaagtattccatctcattgtatattgatgcaatcagcatctaaaaaattagataaatttttatcaaaaataaaaatatttcctccaaaaattccgataattcataattcagatcttcaatttcatacagaaatatcagatattaaaaagtcattaatattacaaatggtttctcctgtacattggttaatgacaataaagaaaatggtaaatttaaatgtttataaaatattagaatgtggtccaggaaaaatattaacaggaataaataaaaaaattaataaaaatttaatttgtcaagcttttatatag

SEQ ID NO: 429 - protein, 296 aa, Candidatus Endoecteinascidia frumentensis
  MISC_FEATURE: EtuF7 amino acid sequence
  MISC_FEATURE: EtuF7 (malonyl CoA-acyl carrier protein transacylase)
MKKIAWVFPGQGSQSIGMLSKYNKHTKIISYFNKASNILGYDLWDICQKDQKKIHQTKYTQPLLLTASIAISRILEERNEQKPDILAGHSLGEYSALLYAQSLSFSDAIKIVSFRGKCMEESGKDNIGGMAAILGLTSKEVFNICMDHSQGEILTPVNFNTADQIVISGHMNAIKRVIKKFHSFKKGKIILLPVSIPSHCILMQSASKKLDKFLSKIKIFPPKIPIIHNSDLQFHTEISDIKKSLILQMVSPVHWLMTIKKMVNLNVYKILECGPGKILTGINKKINKNLICQAFI

SEQ ID NO: 430 - DNA, 753 bp, Candidatus Endoecteinascidia frumentensis
  misc_feature: EtuF8 polynucleotide sequence
  misc_feature: EtuF8 (3-oxoacyl-[acyl-carrier-protein] reductase)
atgtcattattaaaaaataaaatagctcttgtaacaggagcaagcagaggtattggagctgctacgcttgttgaaattggaaaaaaaggaatttatgttattggaacaggtacttccgaaaagagcataaaaagtattttttctttaattcaatcacaaaaaatacatggtactgctatgattttagatgtttctaaaaaatcaagtattgataatttttttcaaaaaattaattttaataaacaaatgccaaatatattaattaataatgcaggcataacaaaagataatttattaattcgaatgtctgaagaagaatggaataatgtaattgaagttaatttatctggtatttttagaataaccaaagcttgtattcgctatatgatccaatctaaatggggacgaattatcaatacaggttctgtagttggaagctctggaaatgcaggtcaagtaaattattgttcagcaaaatctggaatcattggattttctaaagcattagcaaaggaactaggatctagaaatattacagtaaatgttgtatctcctggttttatttatagtgatatggttaaaaatattttaaaaaatcaaaacttatcagataaactaattcaaagcatacctatgtctcgaataggaaatccaaaagatattgcaaatgcaatagtttttttggcttctgaatcagcaaattatattactggacatacattacatgtaaatggtggaatgtttatggcataa

SEQ ID NO: 431 - protein, 250 aa, Candidatus Endoecteinascidia frumentensis
  MISC_FEATURE: EtuF8 amino acid sequence
  MISC_FEATURE: EtuF8 (3-oxoacyl-[acyl-carrier-protein] reductase)
MSLLKNKIALVTGASRGIGAATLVEIGKKGIYVIGTGTSEKSIKSIFSLIQSQKIHGTAMILDVSKKSSIDNFFQKINFNKQMPNILINNAGITKDNLLIRMSEEEWNNVIEVNLSGIFRITKACIRYMIQSKWGRIINTGSVVGSSGNAGQVNYCSAKSGIIGFSKALAKELGSRNITVNVVSPGFIYSDMVKNILKNQNLSDKLIQSIPMSRIGNPKDIANAIVFLASESANYITGHTLHVNGGMFMA

SEQ ID NO: 432 - DNA, 237 bp, Candidatus Endoecteinascidia frumentensis
  misc_feature: EtuF9 polynucleotide sequence
  misc_feature: EtuF9 (acyl carrier protein)
atgaataacattgaagaaagagtaaaaaaaattatagttaaacaattaggggttaaaaaagaagatattagtccaaattcttcatttgtagaagatttaggtgcagattctcttgatacagtagaattggtaatggcattagaagaagaatttgaaactgaaatacctgatgaagatgctgaaaaaatatcaactgtacaaaatgttttagattatatacaaaaaaaacaaaagtaa

SEQ ID NO: 433 - protein, 78 aa, Candidatus Endoecteinascidia frumentensis
  MISC_FEATURE: EtuF9 amino acid sequence
  MISC_FEATURE: EtuF9 (acyl carrier protein)
MNNIEERVKKIIVKQLGVKKEDISPNSSFVEDLGADSLDTVELVMALEEEFETEIPDEDAEKISTVQNVLDYIQKKQK

SEQ ID NO: 434 - DNA, 1242 bp, Candidatus Endoecteinascidia frumentensis
  misc_feature: EtuF10 polynucleotide sequence
  misc_feature: EtuF10 (Beta-ketoacyl-acyl-carrier-protein synthase II)
atgaatgtaaaaactaggagagttgttattaccggaataggcctaattacacctttaggattaaatgtaaaagatacatggagaagaattttaaatggaaaaagtggaattcgtttaattcaaacgtttgatacttcagaatttgcggttaaatttgcaggaacaattcctaattttaatcctgaatcacaaggcctttctacaaaagatgtaaaaaaaatggatataagtattcaaatgggtttagcagctgctattcaagcatggaaagattctgaaattgatataaataaaactaatacatctcgtattggagtatctattggttctggaattggcggtcttacttcaattgtatctaattatgaatctatgaaaaaaaagggtgttagaaaaatatctccatttttcattccatcttctattatcaatatgatttcaggtcaagtgtctctaagatatgggttaaaaggtcctaatattgctattgttagtgcttgtgctactggtacacataatattggatattctgcacgaactatttcttttggtgatgcagatattatgattaccggtggatctgaaaaagctagttgtgaattaggaattggtggatttttagctgcccgtgctttatcaaaacgaaacaatgcacctgaaaaagctagcagaccatgggataaagatcgtgatggatttgtattgggagatggttctggaattttggttttagaagaatatgaacatgctaaaaaaagaaatgcgaaaatttatgctgaaattattggttttggcataagttctgatgcttatcatatgacactaccaaatggtattggagcatatcattctatgaaaaatgcaattaaagatgcatctattacagttgataaaatcaattatatcaatgcccatgccacctctactattgctggagatgtagtagaaagtcaagtaatagaaagaataatgggagattatgcgagaaaagttatggtcagttctactaaatctatgattggacattctttaggtgcttctggagctatagaagcaatattttcaatattatccttatatgatcaagtagttccgcctactattaatttagataatattgatctcaattgtaatttagattacgtaccatatgaagcaagaaacgcaaaattgaatgtaacattgtcaaattcttttggatttggaggaacaaatggaacagttatatttaagaggatataa

SEQ ID NO: 435 - protein, 413 aa, Candidatus Endoecteinascidia frumentensis
  MISC_FEATURE: EtuF10 amino acid sequence
  MISC_FEATURE: EtuF10 (Beta-ketoacyl-acyl-carrier-protein synthase II)
MNVKTRRVVITGIGLITPLGLNVKDTWRRILNGKSGIRLIQTFDTSEFAVKFAGTIPNFNPESQGLSTKDVKKMDISIQMGLAAAIQAWKDSEIDINKTNTSRIGVSIGSGIGGLTSIVSNYESMKKKGVRKISPFFIPSSIINMISGQVSLRYGLKGPNIAIVSACATGTHNIGYSARTISFGDADIMITGGSEKASCELGIGGFLAARALSKRNNAPEKASRPWDKDRDGFVLGDGSGILVLEEYEHAKKRNAKIYAEIIGFGISSDAYHMTLPNGIGAYHSMKNAIKDASITVDKINYINAHATSTIAGDVVESQVIERIMGDYARKVMVSSTKSMIGHSLGASGAIEAIFSILSLYDQVVPPTINLDNIDLNCNLDYVPYEARNAKLNVTLSNSFGFGGTNGTVIFKRI

What is claimed is:

1. A method for producing ET-743 or a metabolic intermediate thereof comprising:
   growing a host cell transformed with one or more expression vectors comprising a polynucleotide encoding one or more polypeptides selected from the group consisting of SEQ ID NOs: 421, 288, 289, 290, 291, 420, 350, 423, 425, 427, 429, 431, 433 and 435 under conditions to express the one or more polypeptides and producing ET-743 or the metabolic intermediate for producing ET-743.

2. The method of claim 1 wherein each of the one or more polypeptides is selected from the group consisting of SEQ ID NOs: 421, 288, 289, 290, 291, 420 and 350.

3. The method of claim 1 wherein ET-743 or the metabolic intermediate thereof is isolated.

4. The method of claim 1 further comprising converting the intermediate to ET-743.

5. The method of claim 1 wherein the producing is completed in the same host cell.

6. A method for producing ET-743 or a metabolic intermediate thereof comprising:
   expressing at least one heterologous polypeptide encoded by an expression vector in a host cell, in wherein the polypeptide comprises the sequence set forth in any one of SEQ ID NOs: 421, 288, 289, 290, 291, 420, 350, 423, 425, 427, 429, 431, 433 or 435 that provides an ET-743 biosynthetic activity, thereby producing ET-743 or the metabolic intermediate thereof.

7. The method of claim 6 wherein the at least one heterologous polypeptide comprises the sequence set forth in any one of SEQ ID NOs: 421, 288, 289, 290, 291, 420, or 350 that provides an ET-743 biosynthetic activity, thereby producing ET-743 or the metabolic intermediate thereof.

8. The method of claim 1 wherein the host cell is a prokaryotic host cell.

9. The method of claim 8 wherein the prokaryotic host cell is *Pseudomonas fluorescens*.

10. The method of claim 1 wherein the host cell comprises a polynucleotide encoding a first polypeptide of SEQ ID NO: 421, 288, 289, 290, 291, 420, 350, 423, 425, 427, 429, 431, 433 or 435.

11. The method of claim 10 wherein the host cell further comprises a polynucleotide encoding a second polypeptide of SEQ ID NO: 421, 288, 289, 290, 291, 420, 350, 423, 425, 427, 429, 431, 433 or 435, wherein the first and second polypeptides are different.

12. The method of claim 11 wherein the host cell further comprises a polynucleotide encoding a third polypeptide of SEQ ID NO: 421, 288, 289, 290, 291, 420, 350, 423, 425, 427, 429, 431, 433 or 435 wherein the first, second, and third polypeptides are different.

13. The method of claim 12 wherein the host cell further comprises a polynucleotide encoding a fourth polypeptide of SEQ ID NO: 421, 288, 289, 290, 291, 420, 350, 423, 425, 427, 429, 431, 433 or 435, wherein the first, second, third and fourth polypeptides are different.

14. The method of claim 13 wherein the host cell further comprises a polynucleotide encoding a fifth polypeptide of SEQ ID NO: 421, 288, 289, 290, 291, 420, 350, 423, 425, 427, 429, 431, 433 or 435, wherein the first, second, third, fourth and fifth polypeptides are different.

15. The method of claim 14 wherein the host cell further comprises a polynucleotide encoding a sixth polypeptide of SEQ ID NO: 421, 288, 289, 290, 291, 420, 350, 423, 425, 427, 429, 431, 433 or 435, wherein the first, second, third, fourth, fifth and sixth polypeptides are different.

\* \* \* \* \*